US008129165B2

(12) United States Patent
Lundberg et al.

(10) Patent No.: US 8,129,165 B2
(45) Date of Patent: Mar. 6, 2012

(54) BORRELIA ANTIGENS

(75) Inventors: Urban Lundberg, Vienna (AT);
Andreas Meinke, Pressbaum (AT);
Eszter Nagy, Vienna (AT); Alexander von Gabain, Vienna (AT); Birgit Noiges, Vienna (AT); Dieter Gelbmann, Weiden am See (AT); Albina Poljak, Vienna (AT); Christine Triska, Vienna (AT)

(73) Assignee: Intercell AG, Vienna (AT)

( * ) Notice: Subject to any disclaimer, the term of this patent is extended or adjusted under 35 U.S.C. 154(b) by 0 days.

(21) Appl. No.: 12/440,161

(22) PCT Filed: Sep. 14, 2007

(86) PCT No.: PCT/AT2007/000439
§ 371 (c)(1),
(2), (4) Date: Jul. 21, 2009

(87) PCT Pub. No.: WO2008/031133
PCT Pub. Date: Mar. 20, 2008

(65) Prior Publication Data
US 2010/0136039 A1 Jun. 3, 2010

(30) Foreign Application Priority Data
Sep. 15, 2006 (EP) .................................. 06019384

(51) Int. Cl.
*C12N 1/20* (2006.01)
*C12P 21/04* (2006.01)
*A61K 39/02* (2006.01)
(52) U.S. Cl. ................. 435/252.1; 435/69.7; 424/190.1; 530/300; 530/350
(58) Field of Classification Search .................. None
See application file for complete search history.

(56) References Cited

U.S. PATENT DOCUMENTS

| 4,946,778 | A |   | 8/1990 | Ladner et al. |
|---|---|---|---|---|
| 5,849,902 | A |   | 12/1998 | Arrow et al. |
| 5,989,912 | A |   | 11/1999 | Arrow et al. |
| 6,902,893 | B1 | * | 6/2005 | Choi et al. ............ 435/6 |

FOREIGN PATENT DOCUMENTS

| CA | 2 045 869 | 12/1991 |
|---|---|---|
| DE | 197 42 706 | 4/1999 |
| EP | 0 533 838 | 12/1997 |
| EP | 0 464 533 | 7/1998 |
| WO | WO 96/02555 | 2/1996 |
| WO | WO 97/30721 | 8/1997 |
| WO | WO 97/47197 | 12/1997 |
| WO | WO 98/08856 | 3/1998 |
| WO | WO 99/38528 | 8/1999 |
| WO | WO 01/24822 | 4/2001 |
| WO | WO 01/54720 | 8/2001 |
| WO | WO 01/78767 | 10/2001 |
| WO | WO 01/93903 | 12/2001 |
| WO | WO 01/93905 | 12/2001 |
| WO | WO 02/13857 | 2/2002 |
| WO | WO 02/16422 A2 | 2/2002 |
| WO | WO 02/32451 | 4/2002 |
| WO | WO 02/095027 | 11/2002 |
| WO | WO 03/047602 | 6/2003 |

OTHER PUBLICATIONS

Broun et al (Science 282:1315-1317, 1998.*
Witkowski et al (Biochemistry 38:11643-11650, 1999).*
Whisstock et al., ( Quarterly Reviews of Biophysics 2003, vol. 36 (3): 307-340 ).*
Devos et al., (Proteins: Structure, Function and Genetics, 2000, vol. 41: 98-107).*
Seffernick et al., (J. Bacteriol. 183(8): 2405-2410, 2001).*
Altschul et al., "Basic Local Alignment Search Tool," *J. Mol. Biol.* 215:403-410, (1990).
Bennett et al., "Kinetic Characterization of the Interaction of Biotinylated Human Interleukin 5 with an Fc Chimera of Its Receptor Alpha Subunit and Development of an ELISA Screening Assay Using Real-Time Interaction Biosensor Analysis," *J. Mol. Recognit.* 8:52-58, (1995).
Burgdorfer et al., "Lyme Disease—A Tick-Borne Spirochetosis," *Science* 216:1317-1319, (1982).

(Continued)

*Primary Examiner* — Padma Baskar
(74) *Attorney, Agent, or Firm* — Wolf, Greenfield & Sacks, P.C.

(57) ABSTRACT

The present invention relates to isolated nucleic acid molecules which encode a protein, isolated nucleic acid molecules which encode a hyperimmune serum reactive antigen, a vector which comprises such nucleic acid molecule, a host cell comprising such vector, a hyperimmune reactive antigen from *Borrelia* species, proteins which are preferably hyperimmune serum reactive antigens, hyperimmune serum reactive antigens, antigens, a process for producing such proteins, hyperimmune serum reactive antigens or antigens, a process for producing a cell which expresses such protein, hyperimmune serum reactive antigen or antigen, an antibody binding to such protein, hyperimmune serum reactive antigen or antigen, a hybridoma cell producing such antibody, methods for producing such antibody, a pharmaceutical composition comprising such nucleic acid molecule, protein, hyperimmune serum reactive antigen, antigen or antibody, the use of such nucleic acid molecule, protein, hyperimmune serum reactive antigen, antigen or antibody for the manufacture of a medicament, methods for identifying an antagonist capable of reducing or inhibiting the interaction activity of such protein, hyperimmune serum reactive antigen or antigen, methods for diagnosing an infection and methods for the treatment of an infection. More specifically such proteins, hyperimmune serum reactive antigens or antigens are produced by or associated with bacterial pathogens causing Lyme disease or bacterial infections caused by *Borrelia burgdorferi* s.l.

8 Claims, 6 Drawing Sheets

OTHER PUBLICATIONS

Casjens et al., "A Bacterial Genome in Flux: The Twelve Linear and Nine Circular Extrachromosomal DNAs in an Infectious Isolate of the Lyme Disease Spirochete *Borrelia burgdorferi,*" *Mol. Microbiol.* 35:490-516, (2000).
Clackson et al., "Making Antibody Fragments Using Phage Display Libraries," *Nature* 352:624-628, (1991).
Devereux et al., "A Comprehensive Set of Sequence Analysis Programs for the VAX," *Nucleic Acids Res.* 12:387-395, (1984).
Doherty et al., "Ribozyme Structures and Mechanisms," *Annu. Rev. Biophys. Struct.* 30:457-475, (2001).
Eisenbraun et al., "Examination of Parameters Affecting the Elicitation of Humoral Immune Responses by Particle Bombardment-Mediated Genetic Immunization," *DNA Cell Biol.* 12:791-797, (1993).
Etz et al., "Bacterial Phage Receptors, Versatile Tools for Display of Polypeptides on the Cell Surface," *J. Bacteriol.* 183:6924-6935, (2001).
Fraser et al., "Genomic Sequence of a Lyme Disease Spirochaete, *Borrelia burgdorferi,*" *Nature* 390:580-586, (1997).
Ganz et al., "Immunology: Enhanced: Defensins and Host Defense," *Science* 286:420-421, (1999).
Georgiou et al., "Display of Heterologous Proteins on the Surface of Microorganisms: From the Screening of Combinatorial Libraries to Live Recombinant Vaccines," *Nat. Biotechnol.* 15:29-34, (1997).
Glöckner et al., "Comparative Analysis of the *Borrelia garinii* Genome," *Nucleic Acids Res.* 32:6038-6046, (2004).
Glöckner et al., "Comparative Genome Analysis: Selection Pressure on the *Borrelia* Vls Cassettes is Essential for Infectivity," *BMC Genomics* 7:211, (2006).
Hashemzadeh-Bonehi et al., "Importance of Using Lac Rather Than Ara Promoter Vectors for Modulating the Levels of Toxic Gene Products in *Escherichia coli,*" *Mol. Microbiol.* 30:673-678, (1998).
Hemmer et al., "Identification of Candidate T-Cell Epitopes and Molecular Mimics in Chronic Lyme Disease," *Nat. Med.* 5:1375-1382, (1999).
Hornef et al., "Bacterial Strategies for Overcoming Host Innate and Adaptive Immune Responses," *Nat. Immunol.* 3:1033-1040, (2002).
Johanson et al., "Binding Interactions of Human Interleukin 5 with Its Receptor Alpha Subunit," *J. Biol. Chem.* 270:9459-9471, (1995).
Jones et al., "Replacing the Complementarity-Determining Regions in a Human Antibody with Those from a Mouse," *Nature* 321:522-525, (1986).
Kajava et al., "The Net Charge of the First 18 Residues of the Mature Sequence Affects Protein Translocation Across the Cytoplasmic Membrane of Gram-Negative Bacteria," *J. Bacteriol.* 182:2163-2169, (2000).
Kohler et al., "Continuous Cultures of Fused Cells Secreting Antibody of Predefined Specificity," *Nature* 256:495-497, (1975).
Kolaskar et al., "A Semi-Empirical Method for Prediction of Antigenic Determinants on Protein Antigens," *FEBS Lett.* 276:172-174, (1990).
Lewin et al., "Ribozyme Gene Therapy: Applications for Molecular Medicine," *Trends Mol. Med.* 7:221-228, (2001).
Livey et al., "Evidence for Lateral Transfer and Recombination in OspC Variation in Lyme Disease *Borrelia,*" *Mol. Microbiol.* 18:257-269, (1995).
State and District of Columbia Health Departments, "Lyme Disease—United States, 2001-2002," *MMWR* 53:365-369, (2004).
Marks et al., "By-Passing Immunization: Building High Affinity Human Antibodies by Chain Shuffling," *Biotechnology (N Y).* 10:779-783, (1992).
McCafferty et al., "Phage Antibodies: Filamentous Phage Displaying Antibody Variable Domains," *Nature* 348:552-554, (1990).
Mehnert et al., "Surveillance of Lyme Borreliosis in Germany, 2002 and 2003," *Euro. Surveill.* 10:83-85, (2005).
Norman et al., "Electronic Computer Solution for the MPN Equation Used in the Determination of Bacterial Populations," *J. Biochem. Microbiol. Technol. Eng.* 2:157-163, (1960).
Okano et al., "Myelin Basic Protein Gene and the Function of Antisense RNA in Its Repression in Myelin-Deficient Mutant Mouse," *J. Neurochem.* 56:560-567, (1991).
Poland et al., "The Prevention of Lyme Disease with Vaccine," *Vaccine* 19:2303-2308, (2001).
Rammensee et al., "SYFPEITHI: Database for MHC Ligands and Peptide Motifs," *Immunogenetics* 50:213-219, (1999).
Report of WHO Workshop on Lyme Borreliosis Diagnosis and Surveillance, (1995). (WHO/CDS/VPH/95.141).
Seeger et al., "The Cloned Genome of Ground Squirrel Hepatitis is Infectious in the Animal," *Proc. Natl. Acad. Sci. USA* 81:5849-5852, (1984).
Skerra et al., "Use of the Tetracycline Promoter for the Tightly Regulated Production of a Murine Antibody Fragment in *Escherichia coli,*" *Gene* 151:131-135, (1994).
Steere et al., "Lyme Arthritis: An Epidemic of Oligoarticular Arthritis in Children and Adults in Three Connecticut Communities," *Arthritis Rheum.* 20:7-17, (1977).
Steere et al., "Lyme Disease," *N. Engl. J. Med.* 321:586-596, (1989).
Tang et al., "Genetic Immunization is a Simple Method for Eliciting an Immune Response," *Nature* 356:152-154, (1992).
Tempest et al., "Reshaping a Human Monoclonal Antibody to Inhibit Human Respiratory Syncytial Virus Infection In Vivo," *Biotechnology (N Y).* 9:266-271, (1991).
Tourdot et al., "A General Strategy to Enhance Immunogenicity of Low-Affinity HLA-A2.1-Associated Peptides: Implication in the Identification of Cryptic Tumor Epitopes," *Eur. J. Immunol.* 30:3411-3421, (2000).
Wilske et al., "Antigenic Variability of *Borrelia burgdorferi,*" *Ann. N. Y. Acad. Sci.* 539:126-143, (1988).
Xu et al., "Analysis and Comparison of Plasmid Profiles of *Borrelia burgdorferi* Sensu Lato Strains," *J. Clin. Microbiol.* 33:2679-2685, (1995).
Gloeckner et al., "Comparative genome analysis: selection pressure on the *Borrelia* vls cassettes is essential for infectivity," (2006).
Gloeckner et al., "Comparative genome analysis: selection pressure on the *Borrelia* vls cassettes is essential for infectivity," *BMC Genomics* 7: 211 (2006).
Dunn, J.J. "*Borrelia burgdorferi* isolate 7 LMP1," (2001).
Wilske et al., "An improved recombinant IgG immunoblot for serodianosis of Lyme borreliosis," (2000).
International Search Report and Written Opinion (PCT/AT2007/000439), mailed Apr. 7, 2008.
International Preliminary Report on Patentability (PCT/AT2007/000439), dated Mar. 17, 2009.
Database EM_PRO; Dec. 19, 1997; "*Borrelia burgdorferi* B31 plasmid 1P28-4, completee sequence"; XP002609247.
Database UniProt; Jun. 1, 1998; "SubName: Full=Putative uncharacterized protein"; XP002609248.
Database EMPL; Jun. 30, 2000; "*Borrelia afzelii* p58 gene for surface antigen, strain pKo"; XP2473889.
European Search Report (EP 10 01 1211), date of completion of the search Nov. 12, 2010.
Written Opinion for Application No. 10 010 875, Jan. 2010.
European Search Report (EP 10 01 0875), date of completion of the search Jan. 4, 2011.
Written Opinion for Application No. 10 011 211, Nov. 2010.

* cited by examiner

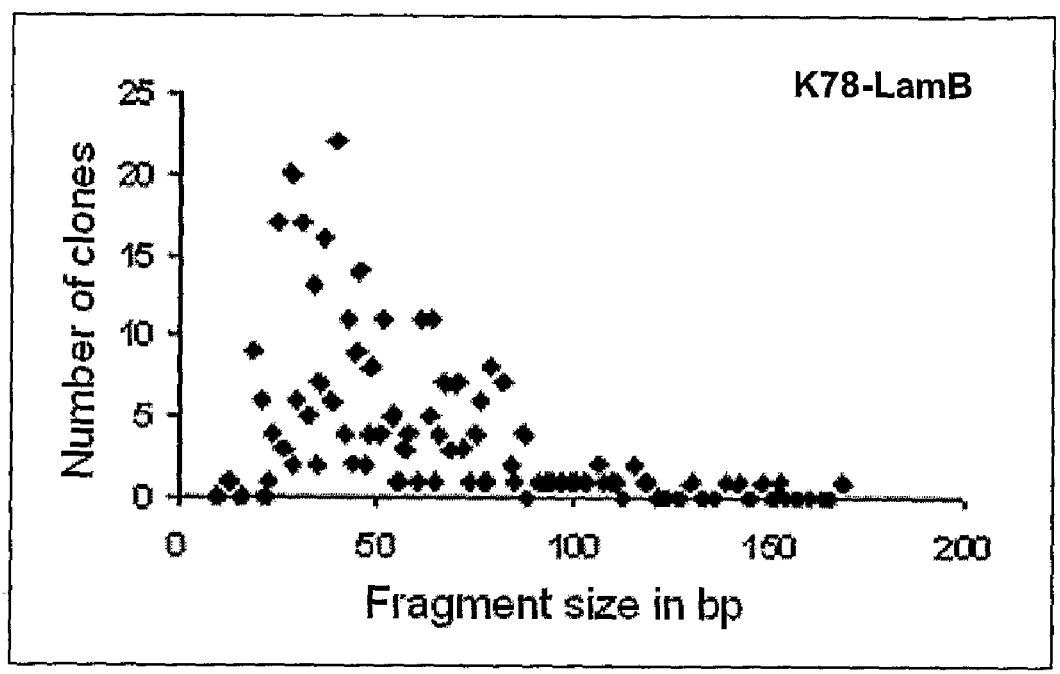

Fig. 5
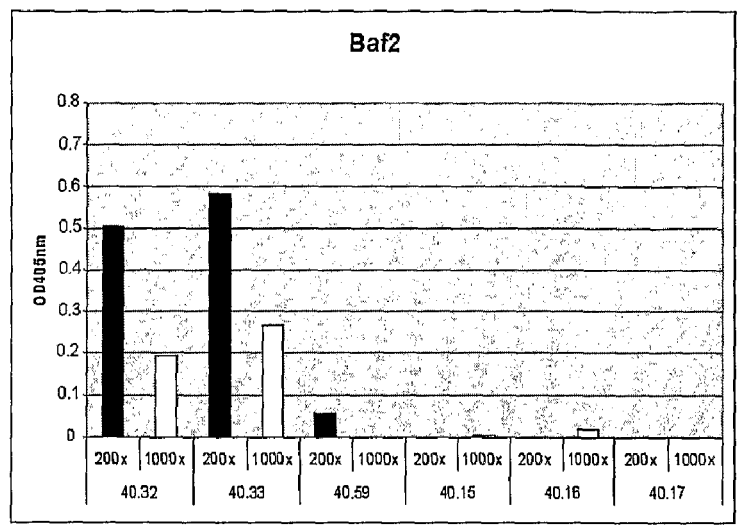
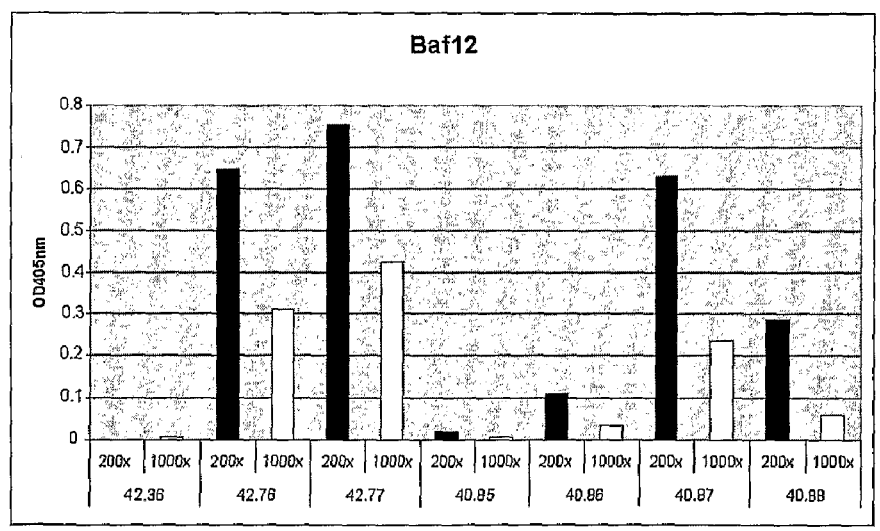
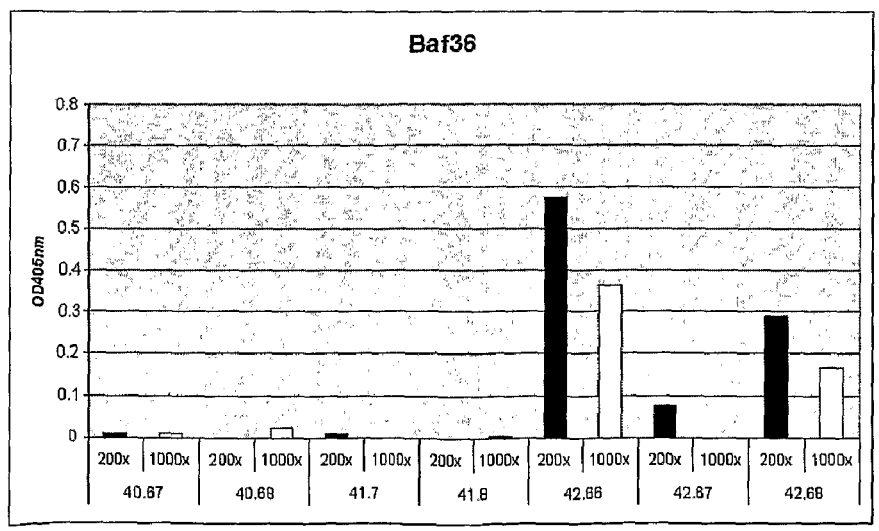

BORRELIA ANTIGENS

The present invention relates to isolated nucleic acid molecules which encode a protein, isolated nucleic acid molecules which encode a hyperimmune serum reactive antigen, a vector which comprises such nucleic acid molecule, a host cell comprising such vector, a hyperimmune reactive antigen from *Borrelia* species, proteins which are preferably hyperimmune serum reactive antigens, hyperimmune serum reactive antigens, antigens, a process for producing such proteins, hyperimmune serum reactive antigens or antigens, a process for producing a cell which expresses such protein, hyperimmune serum reactive antigen or antigen, an antibody binding to such protein, hyperimmune serum reactive antigen or antigen, a hybridoma cell producing such antibody, methods for producing such antibody, a pharmaceutical composition comprising such nucleic acid molecule, protein, hyperimmune serum reactive antigen, antigen or antibody, the use of such nucleic acid molecule, protein, hyperimmune serum reactive antigen, antigen or antibody for the manufacture of a medicament, methods for identifying an antagonist capable of reducing or inhibiting the interaction activity of such protein, hyperimmune serum reactive antigen or antigen, methods for diagnosing an infection and methods for the treatment of an infection. More specifically such proteins, hyperimmune serum reactive antigens or antigens are produced by or associated with bacterial pathogens causing Lyme disease or bacterial infections caused by *Borrelia burgdorferi* s.l.

Lyme borreliosis, or Lyme disease, is the most commonly reported tick-borne disease in Europe and North America. The disease is caused by the arthropod-borne spirochete *Borrelia burgdorferi* sensu lato (*B. burgdorferi* s.l.) and is a multi-systemic infection that can involve multiple organs or tissues, resulting in skin, cardiac, neurological and musculoskeletal disorders. *B. burgdorferi* s.l. can be divided into 12 genospecies. These 12 genospecies occur in different geographic regions, and live in nature in enzootic cycles involving ticks of the *Ixodes ricinus* complex (also called *Ixodes persulcatus* complex) and a wide range of animal hosts (Table A). From these 12 genospecies at least three are pathogenic for humans: *Borrelia burgdorferi* sensu stricto (*B. burgdorferi* s.s.), *B. afzelii* and *B. garinii*. Two other genospecies, *B. lusitaniae* and *B. valaisiana*, have occasionally been detected in humans and their role in Lyme borreliosis are still uncertain.

TABLE A

The *B. burgdorferi* s.l. genospecies, their tick vectors and geographic location.

| | Principal tick vector | Location |
|---|---|---|
| Three pathogenic species | | |
| *Borrelia burgdorferi* s.s. | *Ixodes scapularis* | North-eastern and north central US |
| | *Ixodes pacificus* | Western US |
| | *Ixodes ricinus* | Europe |
| *Borrelia garinii* | *Ixodes ricinus* | Europe |
| | *Ixodes persulcatus* | Asia |
| *Borrelia afzelii* | *Ixodes ricinus* | Europe |
| | *Ixodes persulcatus* | Asia |
| Nine minimally pathogenic or non-pathogenic species | | |
| *Borrelia andersonii* | *Ixodes dentatus* | Eastern US |
| *Borrelia bissettii* | *Ixodes spinipalpis* | Western US |
| | *Ixodes pacificus* | |

TABLE A-continued

The *B. burgdorferi* s.l. genospecies, their tick vectors and geographic location.

| | Principal tick vector | Location |
|---|---|---|
| *Borrelia valaisiana* | *Ixodes ricinus* | Europe and Asia |
| *Borrelia lusitaniae* | *Ixodes ricinus* | Europe |
| *Borrelia spielmani* | *Ixodes ricinus* | Europe |
| *Borrelia japonica* | *Ixodes ovatus* | Japan |
| *Borrelia tanukii* | *Ixodes tanukii* | Japan |
| *Borrelia turdae* | *Ixodes turdus* | Japan |
| *Borrelia sinica* | *Ixodes persulcatus* | China |

Lyme borreliosis was described as a new clinical entity in 1976. Allen C. Steere investigated a group of people with rashes and swollen joints in Old Lyme, Conn., and misdiagnosed Lyme borreliosis as juvenile rheumatoid arthritis (Steere et al., 1977). The disease has, however, been known in Europe under a variety of names since the 1880's. In the year 1883, Buchwald described a chronic skin change, which received the name acrodermatitis chronica atrophicans (ACA). In the year 1910 the Swedish physician Afzelius discovered a circularly moving red rash after an insect or tick bite, which received the name erythema migrans (EM). Neurological symptoms after a tick bite were described 1922 by the French researchers Garin and Bujadoux. In 1951 the Swedish clinician Hollström successfully treated patients with EM with penicillin and in 1984 *Borrelia* cells were observed in skin biopsies taken from an EM lesion. It was suggested that EM in association with meningitis probably was the result of an infection by a tick-borne or an insect-borne bacterium. The causative agent of Lyme borreliosis was finally discovered 1982 by W. Burgdorfer and colleagues, who isolated a previously unidentified spirochetal bacterium from the hard tick *Ixodes scapularis* that was later named *Borrelia burgdorferi* (Burgdorfer et al., 1982).

Epidemiology of Lyme Borreliosis

Lyme borreliosis is the most common tick-borne zoonosis in Europe and North America. While in most countries it is not a notifiable disease, no exact data are available how many new cases there are per year. In the United States the causative agent is *B. burgdorferi* s.s. and Lyme borreliosis is localized in north-eastern, mid-Atlantic and upper north-central states. In 2002, a total of 23,763 cases of Lyme borreliosis were reported to CDC, yielding a national incidence of 8.2 cases per 100,000 inhabitants (Lyme Disease Surveillance in Morbidity Mortality Weekly Reports, 2004). *B. afzelii* and *B. garinii* are the main causative agents of Lyme borreliosis in Europe together with *B. burgdorferi* s.s. which contributes to a lesser extent dependent on the geographic location. In Europe the incidence of Lyme borreliosis differs between countries. The average incidence of Lyme borreliosis in Eastern Germany was 17.8 cases per 100,000 population in 2002 and increased by 31% to 23.3 cases in 2003, respectively. In Austria, the incidence of Lyme borreliosis is much higher with 130 cases per 100,000 inhabitants (Report of WHO workshop on Lyme borreliosis and Diagnosis and surveillance, Warsaw, Poland, 20-22 Jun., 1995).

In some risk groups, such as farmers, forestry workers, hikers, runners or vacationers, seroprevalence and disease incidence rates have increased, as in children under 15 and adults between 39 and 59, without gender preference. The prevalence of Lyme borreliosis varies considerably in different European countries with an overall increased prevalence from west to east. The high incidence of Lyme disease is linked with changes in the forest habitats as well as social factors. An environmental change such as forest fragmentation has led to a loss of rodent predators such as wolves and birds of prey which in turn has led to an increase in the mouse population and automatically to an increase in the tick population. More recently patchy reforestation has increased the numbers of deer and thus the numbers of ticks. Middle class suburban sprawl and the increasing use of these woodland areas for recreation such as camping and hiking has brought humans into greater contact with the larger number of infected ticks. All these parameters contribute to a wider distribution of Lyme borreliosis.

Etiological Agent of Lyme Borreliosis

*B. burgdorferi* s.l. belongs to the family Spirochaetaceae, which is subdivided into the medically important genera *Treponema, Leptospira* and *Borrelia*. *B. burgdorferi* s.l. is a spiral shaped (10-20 µm long and 0.2-0.5 µm wide), vigorously motile, gram negative bacterium that grows under microaerophilic conditions. The spirochetal cell wall consists of a cytoplasmic membrane surrounded by peptidoglycan and flagella and then by a loosely associated outer membrane. The borrelial genome is perhaps the most structurally complex among bacteria and consists of one linear chromosome and a varying number of both linear and circular plasmids (Xu et al., 1995).

In 1997 the genome of *B. burgdorferi* s.s. strain B31 was completely sequenced by TIGR (Fraser et al., 1997), and the following analysis showed that the 1.5 Mb genome sequence is encoded in a single chromosome plus a highly dynamic complement of 12 linear and 9 circular plasmids (Casjens et al., 2000). The genomic sequence of the *B. garinii* strain PBi was published in 2004 (Glöckner et al., 2004). They were only able to assemble two plasmids completely, the remaining plasmids sequence are left as variable plasmid sequences, indicating the complexity and the high content of repetitive sequences. There is a 92% nucleotide sequence identity between the genomes from *B. burgdorferi* s.s. strain B31 and *B. garinii* strain PBi, the sequences of the plasmids are more divergent.

About 90% of the chromosomal genomes comprises coding regions and most of the encoded genes are homologous to genes of known function. They code for proteins involved in DNA replication, transcription and translation; the repair system and recombination; transport, nutrient uptake and energy metabolism; motility and chemotaxis and the regulation of gene expression. Genes related with pathogenicity are primarily located on the extra-chromosomal genome. The genes coding for the synthesis of amino acids, fatty acids, cofactors and nucleotides are absent from the borrelial genome. Therefore *Borrelia* require a complex medium supplemented with serum, such as BSK-II medium, for growth in vitro.

Clinical Manifestations of Lyme Borreliosis

Lyme borreliosis generally occurs in stages, with remission and exacerbations with different clinical manifestation at each stage (Steere, 1989). Early infection stage 1 consists of localized infection of the skin, followed within days or weeks by stage 2, disseminated infection, and months to years later by stage 3, persistent infection. However, the infection is variable; some patients have only localized infections of the skin, while others display only later manifestations of the illness, such as arthritis. Different clinical syndromes of Lyme borreliosis are also caused by infection with diverse *B. burgdorferi* s.l. species. *B. burgdorferi* s.s. more often causes joint manifestations (arthritis) and heart problems, *B. afzelii* causes mainly dermal symptoms (EM and ACA), and *B. garinii* is mostly responsible for neuroborreliosis.

Localized infection—The most common symptom of stage 1 of an infection is erythema migrans, which occurs in 70-80% of infected people. This skin lesion is often followed by flu-like symptoms, such as myalgia, arthralgia, headache and fever. These non-specific symptoms occur in 50% of patients with erythema migrans.

Disseminated infection—During stage 2 the bacteria move into the blood stream from the site of infection and to more distant tissues and organs. Neurological, cardiovascular and arthritic symptoms that occur in this stage include meningitis, cranial neuropathy and intermittent inflammatory arthritis.

Persistent infection—Stage 3 of the infection is chronic and occurs from months to years after the tick bite. The most common symptom in North America is rheumatoid arthritis, caused by an infection with *B. burgdorferi* s.s. Persistent infection of the central nervous system with *B. garinii* causes more severe neurological symptoms during stage 3, and a persistent infection of the skin with *B. afzelii* results in acrodermatitis chronica atrophicans.

Diagnosis and Treatment

The best parameter for diagnosis of early Lyme borreliosis is the characteristic expanding red skin lesion or EM. Unfortunately, 30 percent of patients do not develop this rash, and the usual symptoms of early disease, such as fatigue, fever, or headache, are too non-specific to be diagnostic. Lyme borreliosis in a symptomatic patient can be diagnosed using a variety of serological tests, and the most common diagnostic test is indirect ELISA testing for Lyme specific antibodies in serum.

Antimicrobial agents are the principle method of treatment of Lyme borreliosis infection. The antibiotic used depends on the stage of the disease, symptoms, and the patient's allergies to medication. The length of the antibiotics course also depends on the stage of the disease and severity of symptoms. Early Lyme borreliosis is typically treated with oral tetracyclines, such as doxycycline, and semi-synthetic penicillins, such as amoxicillin or penicillin V. Arthritic and neurological disorders are treated with high-dose intravenous penicillin G or ceftriaxone.

Prevention

The number of cases of Lyme borreliosis steadily increases, as a result of changed ecological conditions. In addition, the difficulty of prevention indicates that the incidence will continue to be a public health concern. Landscape modifications, protective clothing, tick checks or personals protection measures are helpful but not enough, therefore is a vaccine against Lyme borreliosis desirable.

A vaccine can contain a whole variety of different antigens. Examples of antigens are whole-killed or attenuated organisms, subfractions of these organisms/tissues, proteins, or, in their most simple form, peptides. Antigens can also be recognized by the immune system in form of glycosylated proteins or peptides and may also be or contain polysaccharides or lipids. Short peptides can be used since for example cytotoxic T-cells (CTL) recognize antigens in form of short usually 8-11 amino acids long peptides in conjunction with major histocompatibility complex (MHC). B-cells can recognize linear epitopes as short as 4-5 amino acids, as well as three-dimensional structures (conformational epitopes). In order to obtain sustained, antigen-specific immune responses, adjuvants need to trigger immune cascades that involve all cells of the immune system. Primarily, adjuvants are acting, but are not restricted in their mode of action, on so-called antigen presenting cells (APCs). These cells usually first encounter the antigen(s) followed by presentation of processed or unmodified antigen to immune effector cells. Intermediate cell types may also be involved. Only effector cells with the appropriate specificity are activated in a productive immune response. The adjuvant may also locally retain antigens and co-injected other factors. In addition the adjuvant may act as a chemoattractant for other immune cells or may act locally and/or systemically as a stimulating agent for the immune system.

There have been concerns to develop an inactivated whole cell vaccine for humans, because of the potential risk that it may induce cross-reactive antibodies to human antigens. Therefore, subunit vaccines are considered to have the greatest potential in preventing Lyme borreliosis.

Recently, the development of a subunit vaccine to prevent Lyme borreliosis has mainly focused on the outer surface protein A (OspA). The lipidated form of OspA from *B. burgdorferi* s.s. strain ZS7 together with aluminium hydroxide was commercially developed as LYMErix™ by GlaxoSmith-Kline (GSK) for the US market. OspA is mainly expressed in the gut of the tick and human immune responses to *Borrelia* do not usually include humoral or cellular adaptive immunity directed against OspA. Thus, these OspA antibodies produced by vaccination are not used to fight infection in the body. Instead, the antibodies enter the gut of the tick when it takes a blood meal. There, they neutralise the spirochetes and block migration from the midgut to the salivary glands that allows *B. burgdorferi* s.l. to enter the vertebrate host. Thus, the vaccine prevents transmission of the spirochete from the tick to the human host. Three doses of LYMErix™ were needed for optimal protection in the period of one year, and after the first two doses vaccine efficacy against Lyme borreliosis was 49%, and after the third dose 76%. However, shortly after LYMErix™ was commercially available, it was withdrawn from the market in 2002. Some of the reasons are the need for booster injections every year or every other year, relatively high cost of this preventive approach compared with antibiotic treatment of early infection. In addition, there was a theoretical and never proven concern that LYMErix™ could cause autoimmune reactions in a subgroup of the population.

The problem underlying the present invention was to provide means for the development of medicaments such as vaccines against bacterial pathogens causing Lyme borreliosis. More particularly, the problem was to provide an efficient, relevant and comprehensive set of nucleic acid molecules, proteins, hyperimmune serum reactive antigens or antigens from *B. burgdorferi* s.l. that can be used for the manufacture of said medicaments. A still further problem was to provide methods and means for producing a protein, an hyperimmune reactive antigen or an antigen, or a fragment thereof, for identifying an antagonist capable of reducing or inhibiting the interaction activity of such protein, hyperimmune reactive antigen or antigen with an interaction partner thereof and preferably an antibody directed thereagainst, for treating infections, for immunizing an animal or man.

The problem underlying the present invention is solved in a first aspect by an isolated nucleic acid molecule encoding a protein, preferably a hyperimmune serum reactive antigen, or a fragment thereof, comprising a nucleic acid sequence, which is selected from the group consisting of:
 a) a nucleic acid molecule having at least 70% sequence identity to a nucleic acid molecule having a nucleotide sequence selected from the group comprising Seq ID Nos 1 to 134,
 b) a nucleic acid molecule which is complementary to the nucleic acid molecule of a),
 c) a nucleic acid molecule comprising at least 15 sequential bases of the nucleic acid molecule of a) or b),
 d) a nucleic acid molecule which anneals under stringent hybridisation conditions to the nucleic acid molecule of a), b), or c),
 e) a nucleic acid molecule which, but for the degeneracy of the genetic code, would hybridise to the nucleic acid molecule defined in a), b), c) or d).

The problem underlying the present invention is solved in a second aspect by an isolated nucleic acid molecule encoding a hyperimmune serum reactive antigen, or a fragment thereof, comprising a nucleic acid sequence, which is selected from the group consisting of:
 a) a nucleic acid molecule having at least 70% sequence identity to a nucleic acid molecule having a nucleotide sequence selected from the group comprising Seq ID Nos 269 to 387 and 507 to 628,
 b) a nucleic acid molecule which is complementary to the nucleic acid molecule of a),
 c) a nucleic acid molecule comprising at least 15 sequential bases of the nucleic acid molecule of a) or b),
 d) a nucleic acid molecule which anneals under stringent hybridisation conditions to the nucleic acid molecule of a), b), or c),
 e) a nucleic acid molecule which, but for the degeneracy of the genetic code, would hybridise to the nucleic acid molecule defined in a), b), c) or d).

In an embodiment of the first and the second aspect the sequence identity is at least 70%, at least 85%, at least 90%, at least 95% or 100%.

In an embodiment of the first and the second aspect the nucleic acid is DNA.

In an alternative embodiment of the first and the second aspect the nucleic acid is RNA.

In an embodiment of the first and the second aspect the nucleic acid molecule is isolated from a genomic DNA, preferably from a species selected from the group comprising *Borrelia burgdorferi* s.s., *Borrelia garinii*, *Borrelia afzelii*, *Borrelia andersonii*, *Borrelia bissettii*, *Borrelia valaisiana*, *Borrelia lusitaniae*, *Borrelia spielmani*, *Borrelia japonica*, *Borrelia tanukii*, *Borrelia turdae* and *Borrelia sinica*, and more preferably from *Borrelia burgdorferi* s.s., *Borrelia afzelii* or *Borrelia garinii* genomic DNA.

In an embodiment of the first and the second aspect the fragment is a functional or an active fragment or an active variant thereof.

In an embodiment of the first and the second aspect the protein or the hyperimmune serum reactive antigen, or fragment thereof, is or consists of an antigen from *Borrelia burgdorferi* s.s., *Borrelia garinii*, *Borrelia afzelii*, *Borrelia andersonii*, *Borrelia bissettii*, *Borrelia valaisiana*, *Borrelia lusitaniae*, *Borrelia spielmani*, *Borrelia japonica*, *Borrelia tanukii*, *Borrelia turdae* or *Borrelia sinica*, preferably from *Borrelia burgdorferi* s.s., *Borrelia afzelii* or *Borrelia garinii*.

The problem underlying the present invention is solved in a third aspect by a vector comprising a nucleic acid molecule according to the first or the second aspect.

In an embodiment of the third aspect the vector is adapted for recombinant expression of a protein, preferably the protein or the hyperimmune serum reactive antigen, or a fragment thereof, encoded by the nucleic acid molecule as defined in the first or the second aspect.

The problem underlying the present invention is solved in a fourth aspect by a host cell comprising the vector as defined in the third aspect.

The problem underlying the present invention is solved in a fifth aspect by a hyperimmune serum reactive antigen from *Borrelia burgdorferi* s.s., *Borrelia afzelii* or *Borrelia garinii* that is immunologically reactive with sera from a human having a *Borrelia burgdorferi* s.s. infection, a *Borrelia afzelii* infection or a *Borrelia garinii* infection, or an uninfected healthy human, whereby the hyperimmune serum reactive antigen comprises an isolated peptide from *Borrelia burgdorferi* s.s., *Borrelia afzelii* or *Borrelia garinii*, or a peptide fragment thereof.

The problem underlying the present invention is solved in a sixth aspect by a protein, preferably a hyperimmune serum reactive antigen, having an amino acid sequence selected from the group comprising Seq ID Nos 135 to 268, or an active fragment or an active variant thereof.

The problem underlying the present invention is solved in a seventh aspect by a hyperimmune serum reactive antigen having an amino acid sequence selected from the group comprising Seq ID Nos 388 to 506 and 629 to 750, or an active fragment or an active variant thereof.

In an embodiment of the sixth aspect the protein is encoded by a nucleic acid molecule as defined in the first aspect.

In an embodiment of the seventh aspect the antigen is encoded by a nucleic acid molecule as defined in the second aspect.

In an embodiment of the sixth and the seventh aspect the protein or the antigen is or consists of an antigen from *Borrelia burgdorferi* s.s., *Borrelia afzelii* or *Borrelia garinii*.

In an embodiment of the sixth and seventh aspect the active fragment thereof consists of at least 60%, preferably at least 70%, more preferably at least 80%, still more preferably at least 90%, even more preferably at least 95%, most preferably 99% of the protein or the hyperimmune serum reactive antigen as defined in the sixth and the seventh aspect and more specifically of the protein or hyperimmune serum reactive antigen of any of Seq ID Nos 135 to 268, 388 to 506 or 629 to 750.

In an embodiment of the sixth and seventh aspect the active variant thereof has at least 50% sequence identity to the hyperimmune serum reactive antigen or the protein, especially at least 60%, preferably at least 70%, more preferably at least 80%, still more preferably at least 90%, even more preferably at least 95%, most preferably 99% sequence identity to said hyperimmune serum reactive antigen or protein as defined in the sixth and the seventh aspect and more specifically to the protein or the hyperimmune serum reactive antigen of any of Seq ID Nos 135 to 268, 388 to 506 or 629 to 750.

The problem underlying the present invention is solved in an eighth aspect by an antigen, whereby the antigen comprises a core amino acid sequence as indicated in column "Predicted immunogenic aa" and "Location of identified immunogenic region" of Table 1, as indicated in column "aa (start-stop)" of Table 5, as defined by columns "From aa" and "To aa" of Table 6, or as defined by column "Amino acid From-To" of Table 8, whereby more preferably such antigen comprises a core amino acid sequence as follows:
amino acids 6-20, 25-51, 58-83, 94-105, 111-122, 127-135, 141-155, 162-173, 179-186, 188-207, 213-226, 230-248, 253-265, 269-282, 285-291, 367-378, 384-393, 401-425, 453-464, 471-477, 504-514, 519-527, 532-555, 557-572, 584-598, 609-616, 624-630, 638-645, 648-653, 128-169, 257-336, 339-379 and 91-415 of Seq ID No 135; amino acids 23-31, 47-53, 57-64, 74-89, 91-106, 127-132, 137-144, 152-157, 164-169, 186-192, 201-206, 208-217, 223-235 and 180-189 of Seq ID No 136; amino acids 4-32, 43-52, 54-66, 78-88, 91-122, 124-131, 144-150, 153-159, 161-178, 183-191, 195-201, 205-215, 236-252, 258-263, 276-284, 288-294, 302-312 and 159-213 of Seq ID No 137; amino acids 8-23, 30-35, 44-54, 65-73, 77-83, 89-110, 117-129, 132-137, 156-165, 169-175, 189-199, 225-237 and 229-267 of Seq ID No 138; amino acids 5-31, 40-50, 52-58, 64-72, 112-118, 137-142, 170-175, 179-185, 192-201, 299-305 and 138-187 of Seq ID No 139; amino acids 11-18, 23-47, 113-119, 131-137, 143-149, 197-203, 215-222, 247-256, 264-290, 298-303, 311-358, 368-401, 403-409 and 97-177 of Seq ID No 140; amino acids 5-20, 27-32, 34-40, 43-64, 66-72, 78-85, 91-97, 104-110, 118-141 and 94-119 of Seq ID No 141; amino acids 5-22, 25-32, 39-45, 51-58, 60-104, 106-114, 129-155, 160-166, 174-182, 195-204, 207-213, 223-239, 243-250, 257-267, 270-276, 279-285, 293-302, 304-317, 328-335, 360-372, 374-382, 386-397, 404-418, 429-438, 441-447, 450-460, 467-472, 480-497, 501-507, 515-521, 562-572 and 195-228 of Seq ID No 142; amino acids 4-10, 31-42, 44-59, 65-72, 75-115, 119-127, 146-155, 181-188, 198-207, 213-219, 228-244, 254-264, 269-293, 295-310, 313-321, 323-336, 350-369, 380-389 and 165-214 of Seq ID No 143; amino acids 11-25, 27-45, 66-73, 75-85, 104-113, 126-135, 143-154, 160-166, 178-185, 201-215, 231-245, 254-261, 266-296, 298-306, 308-332, 339-344, 360-370, 385-391, 412-419, 449-457, 461-469, 472-478, 495-505, 511-518 and 350-451 of Seq ID No 144; amino acids 14-35, 64-72, 81-87, 90-99, 110-116, 137-152, 158-166, 171-178, 207-216, 225-232, 239-250, 264-271, 276-286, 316-323, 325-343, 350-356, 393-407, 416-422, 440-445, 448-453, 469-475, 497-506, 509-529, 537-543, 586-592, 603-610, 41-107 and 528-596 of Seq ID No 145; amino acids 56-62, 83-96, 161-167, 170-179, 184-197, 205-214, 235-243, 285-296, 302-308, 324-333 and 18-315 of Seq ID No 146; amino acids 4-11, 35-41, 57-65, 82-88, 99-115, 118-124, 126-134, 146-151, 159-167, 174-180, 187-192, 195-206, 216-222, 237-247, 261-269, 295-304, 327-334, 341-347, 363-374, 382-388, 398-404, 410-424, 430-436, 441-448, 451-461, 473-484, 493-507, 509-522, 528-536, 544-550, 566-573, 588-604, 608-614, 22-75, 110-148 and 344-404 of Seq ID No 147; amino acids 4-14, 21-28, 32-38, 59-71, 84-106, 110-120, 127-140, 146-167, 184-190, 197-203, 223-232, 249-278, 280-292, 309-324, 342-355, 367-374, 377-384 and 264-328 of Seq ID No 148; amino acids 13-18, 47-55, 65-75, 132-138, 140-146, 149-155, 157-168, 218-227, 241-248, 275-281, 283-289, 306-315, 329-336, 352-360, 372-378, 388-394, 396-404, 411-416, 424-429, 445-455, 479-491, 494-500, 571-578, 583-588, 600-621, 6-65, 68-112, 261-352 and 449-507 of Seq ID No 149; amino acids 10-34, 36-42, 46-55, 58-64, 79-86, 99-122, 125-135, 165-184, 200-209, 215-226, 232-238 and 79-89 of Seq ID No 150; amino acids 4-34, 38-62, 64-78, 87-99, 101-109, 113-125, 128-156, 166-184, 186-193, 196-203, 205-215, 220-226, 236-260, 262-269, 271-288, 296-302, 325-333, 339-350 and 111-138 of Seq ID No 151; amino acids 8-23, 25-33, 57-68, 102-113, 194-199, 236-241, 269-296, 326-333, 339-348, 352-360, 364-369, 378-393, 422-430, 434-447, 476-484, 488-501, 530-538, 542-555, 585-592, 596-609, 638-646, 650-663, 692-699, 706-716, 726-745, 765-771, 792-798, 809-815, 825-835, 862-868, 878-885, 893-902, 911-922, 927-937, 947-953, 962-970, 978-985, 1011-1017, 1027-1034, 1045-1052, 102-177, 285-364, 937-983, 27-246 and 701-1067 of Seq ID No 152; amino acids 4-20, 36-45, 62-69, 73-83, 95-112, 153-166, 178-185, 194-205, 215-223, 238-247 and 80-159 of Seq ID No 153; amino acids 82-95, 107-122, 153-158, 165-171, 178-196, 202-210, 216-222, 270-280, 312-318, 336-341, 381-389 and 245-299 of Seq ID No 154; amino acids 4-23, 45-57, 68-81, 91-104, 118-131, 134-144, 160-166, 172-189, 191-202, 204-217, 228-236, 261-268, 273-285, 287-294, 307-316, 328-343, 350-356, 381-418, 420-429, 440-452, 458-465, 497-504, 528-538, 546-556, 567-574, 580-601, 605-624, 628-639, 647-653 and 126-200 of Seq ID No 155; amino acids 4-19, 24-30, 32-48, 53-80, 89-97, 102-109, 136-142, 145-153, 156-164, 177-187, 192-209, 215-221, 238-243, 15-146 and 21-257 of Seq ID No 156; amino acids 5-13, 70-79, 91-97, 123-129, 155-162, 173-189, 199-224, 232-238, 255-261, 265-283, 290-301, 306-311, 314-320, 336-344, 351-

358, 395-409, 412-418, 430-439, 35-109 and 187-298 of Seq ID No 157; amino acids 13-31, 36-47, 80-96, 98-107, 144-149, 187-193, 215-220, 235-251, 291-300, 306-326, 328-338, 340-358, 364-380, 408-426, 434-441 and 220-288 of Seq ID No 158; amino acids 4-24, 36-43, 70-81, 89-100, 109-120, 127-132, 141-158, 165-178, 183-191, 193-202, 208-215 and 31-89 of Seq ID No 159; amino acids 6-25, 44-49, 95-105, 136-144, 199-215, 236-241, 256-262, 280-287, 306-320, 326-334, 346-354, 364-376, 83-172 and 272-327 of Seq ID No 160; amino acids 4-21, 27-44, 85-92, 100-107, 112-118, 142-149, 161-190, 216-222, 231-238, 258-310, 317-323, 334-344, 352-359, 367-373, 380-387, 394-400, 429-441, 485-500, 20-79 and 404-526 of Seq ID No 161; amino acids 12-28, 38-58, 61-75, 98-116, 121-127, 133-142, 169-199, 213-221, 236-241, 243-250, 254-260, 269-281, 284-301, 313-319, 352-358, 362-368, 391-397, 436-448, 455-463, 485-496, 498-511, 523-533, 40-97, 251-297 and 420-488 of Seq ID No 162; amino acids 8-15, 24-41, 50-79, 86-91, 109-141, 143-156, 166-171, 204-212, 235-243, 245-267, 291-311, 328-336, 344-360, 377-388, 390-396 and 258-336 of Seq ID No 163; amino acids 4-15, 22-38, 46-53, 72-82, 99-119, 131-139, 148-154, 179-184, 187-195, 203-209, 212-219, 223-231, 242-249, 257-263, 269-277, 282-288, 310-315, 346-353, 371-377, 388-395, 400-421, 427-438, 445-451 and 458-472 of Seq ID No 164; amino acids 5-29, 37-117, 128-134, 138-144, 146-161, 172-178, 193-219, 221-231, 234-240, 242-261, 263-274, 297-302, 306-322, 339-345, 356-365, 371-383, 402-413, 416-424, 432-443, 447-456, 461-466, 471-524, 532-593 and 197-284 of Seq ID No 165; amino acids 5-29, 54-69, 72-88, 99-112, 128-138, 150-165, 167-174, 181-187, 205-226, 246-253, 273-279, 285-291, 293-311, 313-323, 329-334, 338-350, 356-363, 366-372, 388-394, 397-404, 417-423, 437-445, 453-473 and 378-461 of Seq ID No 166; amino acids 38-45, 67-82, 90-96, 101-108, 113-120, 128-143, 160-173, 190-200, 206-218, 226-237, 244-252, 256-271, 276-285, 298-309, 319-325, 332-350, 355-363, 379-388, 395-404, 412-419, 427-433, 442-455, 82-127 and 212-253 of Seq ID No 167; amino acids 10-28, 37-50, 58-66, 72-91, 101-119, 124-131, 133-149, 152-170, 177-186, 198-204, 225-244, 249-256, 260-266, 269-286, 298-303, 306-312, 329-338, 342-348 and 26-73 of Seq ID No 168; amino acids 10-18, 45-51, 58-87, 95-139, 175-182, 184-194, 228-237, 239-245, 255-261, 269-282, 289-295, 301-308, 310-319, 333-374, 376-383, 394-447, 455-464, 485-503, 519-526, 532-542, 551-557, 571-604, 608-614, 616-623, 654-660, 682-687, 717-724, 729-736, 759-775, 800-806, 817-823, 829-838, 840-864, 877-887, 900-906, 943-951, 959-978, 981-994, 996-1012, 1016-1032, 1035-1046, 1049-1056, 1078-1109, 1117-1124, 1137-1143, 1158-1167, 1179-1199, 1201-1207, 1215-1245, 1250-1256, 1262-1268, 1270-1281, 1298-1310, 1314-1323, 1326-1333, 1347-1357, 1364-1372 and 1053-1082 of Seq ID No 169; amino acids 4-9, 15-27, 29-37, 50-59, 65-73, 94-107, 138-168, 179-187, 191-203, 230-237, 254-260, 267-274, 279-294, 312-328, 355-361, 368-375, 378-388, 405-415, 441-457, 459-467, 469-476, 496-506, 508-514, 521-531, 538-549, 554-561, 566-574, 582-591, 604-625, 640-653, 657-671, 674-689, 698-705, 713-723, 746-756, 763-771, 777-789, 801-809, 822-839, 847-854, 865-872, 877-883, 889-906, 922-940, 943-953, 963-984, 1004-1010, 1021-1037, 1045-1057, 1070-1089, 1096-1115, 1117-1123, 1127-1135 and 194-292 of Seq ID No 170; amino acids 10-30, 38-51, 74-81, 86-96, 116-148, 161-167, 202-208, 211-217, 239-261, 283-295, 298-310, 322-328, 335-346 and 44-99 of Seq ID No 171; amino acids 9-23, 31-42, 50-60, 68-74, 85-92, 98-106, 108-117, 135-142, 144-150, 155-172, 174-191, 193-206, 208-215, 223-233, 237-245, 252-267, 274-296, 308-316, 324-341, 375-385, 394-402, 419-440, 446-452, 493-499, 514-520, 537-546, 570-579, 582-588, 591-603, 609-618, 620-628, 640-687, 700-706, 714-742, 765-774, 794-805, 809-825, 827-838, 847-857, 860-867, 875-888, 897-907, 917-926, 937-942, 950-971, 975-981, 989-999, 1016-1052, 1054-1071, 1089-1105, 1108-1130, 1142-1160, 1166-1178, 1184-1197, 1199-1207, 1216-1222, 1232-1247, 1249-1254, 1262-1283, 1291-1300, 1308-1332, 1343-1356, 1363-1368, 1384-1398, 1401-1410, 1423-1434, 1443-1464, 1478-1484 and 1229-1275 of Seq ID No 172; amino acids 5-15, 21-35, 42-51, 55-60, 73-80, 87-94, 103-110, 134-146, 157-168, 174-188, 190-201, 209-223, 250-257, 110-131 and 179-236 of Seq ID No 173; amino acids 10-24, 30-48, 52-66, 90-100, 111-137, 153-162, 166-175, 184-190, 193-206, 226-232, 238-248, 250-260, 267-273, 322-333, 349-382, 402-413, 421-428, 443-451, 470-480, 487-498, 508-518, 526-539, 544-549, 568-574, 607-623, 631-636 and 372-434 of Seq ID No 174; amino acids 20-28, 33-38, 45-77, 91-110, 124-130, 137-162, 164-170, 175-183, 185-205, 207-217, 235-240, 254-269, 291-296, 319-326, 342-354, 374-381, 397-403, 424-434, 442-455, 469-484, 494-501, 513-522, 529-534, 546-556, 558-564 and 439-464 of Seq ID No 175; amino acids 4-13, 15-21, 24-32, 40-45, 47-65, 75-110, 114-123, 133-142, 144-159, 164-171, 187-215 and 12-77 of Seq ID No 176; amino acids 4-9, 25-44, 49-60, 72-82, 87-105, 125-138, 142-155, 171-179, 183-197, 205-225, 232-244, 256-270, 278-285, 287-293, 310-333, 339-345, 350-366, 368-378, 381-392, 397-404, 408-418 and 281-316 of Seq ID No 177; amino acids 28-35, 95-116, 138-146, 150-158, 174-203 and 33-78 of Seq ID No 178; amino acids 4-23, 31-43, 58-64, 68-83, 93-103, 121-135, 143-156, 181-187, 227-238, 251-264, 292-298, 309-317, 326-333, 351-357, 359-365, 387-395, 400-407, 431-437, 451-460, 462-471, 496-508, 519-526, 534-540, 568-573, 608-618, 620-627, 650-657, 673-679, 690-702, 705-714, 728-734, 738-745, 758-764, 776-782, 795-810, 830-839, 882-904, 911-926, 938-944, 962-969, 975-984, 999-1007, 1019-1025, 1072-1090, 1099-1111, 1172-1178, 1232-1241, 1245-1252, 1257-1266, 1283-1288, 1305-1311, 1370-1377, 1392-1398, 1412-1417, 1422-1434, 1448-1458, 1479-1487, 1529-1534, 1570-1576, 1582-1590, 1615-1622, 1630-1645, 1659-1668, 1700-1708, 1730-1736, 1756-1762, 1765-1776, 1798-1803, 1805-1819, 1831-1837, 1872-1882, 1926-1936, 1946-1952, 1955-1961, 1968-1980, 1995-2002, 2035-2045, 2048-2056, 2076-2083, 2099-2107, 2122-2128, 2146-2156, 718-788 and 399-870 of Seq ID No 179; amino acids 12-19, 22-29, 37-43, 48-56, 79-90, 114-119, 136-147, 162-172, 174-180, 186-194, 200-213, 232-238, 275-282, 288-297, 303-319, 329-338, 341-351, 363-371, 383-397, 416-423, 430-438, 454-472, 476-483, 536-542, 576-581, 626-632, 66-161 and 494-576 of Seq ID No 180; amino acids 29-35, 48-56, 82-89, 106-112, 118-126, 144-149, 157-173, 175-184 and 1-52 of Seq ID No 181; amino acids 14-36, 48-54, 79-85, 149-159, 171-182, 189-205, 211-217 and 171-240 of Seq ID No 182; amino acids 9-23, 30-40, 56-70, 75-80, 97-103, 111-117, 130-135, 139-145, 149-160, 250-256, 276-286, 309-315, 326-331, 364-376, 385-391, 400-412, 429-434, 446-462, 472-498 and 363-430 of Seq ID No 183; amino acids 4-28, 44-60, 73-81, 88-94, 102-108, 119-127, 145-170, 201-208, 220-227, 229-239, 291-297, 306-323, 327-335, 342-369, 372-394, 414-420, 427-445, 456-462, 471-478, 494-503, 505-510, 536-542, 549-567, 585-594, 614-627 and 215-283 of Seq ID No 184; amino acids 4-10, 27-33, 40-48, 64-70, 82-96, 108-115, 123-131, 171-176, 182-204 and 151-160 of Seq ID No 185; amino acids 4-15, 19-36, 39-47, 51-57, 62-69, 77-84, 91-97, 103-112, 117-136, 148-168, 189-195, 204-211, 213-228, 234-243, 268-274, 280-289, 294-308, 314-335, 341-349, 354-

375, 382-392, 394-405, 419-424, 430-435, 442-469, 479-489, 500-507, 510-516, 523-534, 536-545, 560-579, 586-592, 614-620, 639-649, 652-663, 665-702, 704-710, 727-732, 743-755, 761-781, 799-805, 810-816, 842-851, 885-891, 904-912, 924-931, 933-946, 948-973, 980-988, 990-1007, 1017-1023, 1027-1035, 1046-1055, 1063-1074, 1086-1091, 1095-1102, 1116-1122, 1149-1158 and 458-497 of Seq ID No 186; amino acids 4-23, 26-32, 50-56, 72-85, 87-104, 106-113, 116-151, 159-174, 176-184, 187-194, 199-206, 211-232, 242-261, 91-170 and 22-264 of Seq ID No 187; amino acids 4-24, 53-58, 65-72, 84-96, 106-113, 115-125, 149-154, 176-191, 215-222, 239-244, 267-275, 278-304, 323-340, 345-351, 416-424, 449-455, 473-483, 523-537, 540-556, 564-583, 605-616, 36-119 and 343-394 of Seq ID No 188; amino acids 11-27, 45-52, 60-74, 96-102, 123-136, 140-155, 167-189, 194-201, 209-230, 254-261, 264-284, 289-294, 297-305, 319-325, 338-343, 349-361, 363-377, 381-388, 396-409, 413-422, 435-441, 455-469 and 342-386 of Seq ID No 189; amino acids 9-45, 47-54, 72-78, 81-96, 111-118, 123-130, 133-143, 148-154, 157-182, 202-215, 241-255, 290-311, 316-334, 340-346, 349-356, 366-385, 387-400, 403-411 and 156-286 of Seq ID No 190; amino acids 26-45, 62-70, 84-121, 129-138, 146-168, 182-188, 197-207, 213-220, 222-229, 246-257, 277-283, 304-314, 328-336, 348-371, 375-385, 388-396, 409-421, 429-438, 451-459, 465-485, 501-528, 530-536, 555-581, 589-594, 607-614, 620-626, 628-634, 637-643, 650-658, 665-671, 680-691, 703-709, 721-742, 746-758, 761-767, 772-777, 784-790, 796-810 and 747-795 of Seq ID No 191; amino acids 4-11, 15-37, 52-66, 79-90, 96-106, 110-118, 124-137, 152-160, 162-171, 174-182, 200-209, 215-222, 227-242, 248-264, 284-308, 325-340, 362-369, 390-418, 420-426, 440-454, 463-471, 478-485, 490-512, 517-532, 539-545, 570-583, 591-605, 621-630, 643-652, 655-665, 684-694, 75-223 and 285-348 of Seq ID No 192; amino acids 8-18, 25-57, 93-107, 121-128, 135-141, 159-176, 183-191, 202-223, 229-236, 298-304, 332-340, 359-368, 384-393, 410-426, 434-439, 444-449, 476-491, 502-508, 511-523, 525-533, 548-554 and 390-409 of Seq ID No 193; amino acids 13-31, 35-41, 50-58, 70-81, 91-100, 120-128, 143-149, 185-191, 196-203, 213-239, 241-251, 256-277, 289-303, 305-316, 364-388, 394-403, 406-412, 417-426, 440-446, 462-469, 494-502, 504-522 and 6-100 of Seq ID No 194; amino acids 7-14, 30-36, 43-52, 54-65, 71-85, 95-101, 113-119, 121-127, 153-170, 179-188, 191-200, 204-210, 214-222, 227-233, 244-250 and 168-223 of Seq ID No 195; amino acids 14-21, 25-39, 54-64, 74-99, 102-129, 139-153, 159-166, 188-206, 214-220, 236-243, 245-255, 262-269, 276-295, 300-309, 315-321, 324-331 and 12-84 of Seq ID No 196; amino acids 4-13, 26-33, 35-49, 55-68, 74-82, 96-114, 116-148, 150-161, 229-235, 237-254, 257-266, 280-286, 305-312, 320-337, 343-356, 373-382, 384-427, 433-439 and 50-64 of Seq ID No 197; amino acids 4-46, 53-78, 103-113, 117-122, 144-149, 168-174, 176-183, 193-200, 207-238, 252-259, 271-277, 279-307, 315-326, 330-391, 412-423, 425-464, 472-478, 508-526, 531-542, 551-560, 562-576, 584-593, 602-608, 616-637, 658-666, 714-719, 721-730, 28-73, 292-344, 531-608 and 391-753 of Seq ID No 198; amino acids 4-21, 26-33, 69-78, 80-93, 109-125, 127-134, 137-146, 154-160, 162-169, 173-182, 189-199, 210-220, 224-242, 246-278, 284-290, 294-308 and 223-272 of Seq ID No 199; amino acids 10-30, 33-42, 46-62, 64-70, 82-97, 112-122, 124-130, 138-145, 148-165, 167-178, 186-192, 196-209, 213-218, 241-249, 258-276, 279-288, 291-299, 302-307, 315-337, 344-349, 360-376, 390-402, 409-415, 417-428, 452-468, 475-484, 486-492 and 180-232 of Seq ID No 200; amino acids 17-24, 32-43, 49-55, 62-69, 78-92, 97-118, 132-139, 148-154, 173-179, 181-189, 191-210 and 117-131 of Seq ID No 201; amino acids 4-18, 35-44, 54-67, 77-85, 92-101, 106-119, 131-144, 146-164, 171-177, 182-191, 203-218, 282-288, 297-310, 343-359, 361-367, 400-405, 433-439, 454-462, 483-492, 496-504, 506-517, 522-529, 552-559, 564-572, 574-580, 590-604, 625-660 and 252-396 of Seq ID No 202; amino acids 33-50, 67-75, 89-95, 107-116, 119-126, 151-158, 165-170, 175-187, 237-243, 252-258, 272-282, 323-332 and 115-166 of Seq ID No 203; amino acids 14-23, 41-53, 63-107, 111-134, 136-155, 179-210, 223-233, 261-267, 285-290, 296-302 and 203-299 of Seq ID No 204; amino acids 22-31, 35-41, 53-62, 64-75, 79-90 and 1-22 of Seq ID No 205; amino acids 4-14, 17-30, 33-44, 54-62, 67-76, 78-97, 112-118, 143-152, 163-169, 175-188, 191-199, 207-216, 232-239, 243-249, 262-268, 289-296, 312-319, 335-340, 1-35 and 183-264 of Seq ID No 206; amino acids 5-18, 37-53, 56-66, 74-81, 100-110, 120-131, 135-141, 150-156, 174-181, 189-196, 202-211, 225-235, 246-251, 255-260, 311-319, 326-332 and 245-332 of Seq ID No 207; amino acids 4-25, 28-34, 41-49, 71-78, 101-120, 125-156, 167-173, 190-199, 207-213, 218-230, 256-267, 269-275, 286-304, 312-320, 341-349, 363-371, 375-384 and 318-384 of Seq ID No 208; amino acids 23-39, 48-58, 60-82, 85-104, 106-112, 117-142, 181-191, 205-213, 219-236, 242-251, 263-276, 295-302, 308-315, 320-330, 335-343, 363-372, 387-392, 413-419, 430-457, 462-470, 477-492, 499-505, 531-540, 542-548, 568-600, 607-614, 620-630 and 36-419 of Seq ID No 209; amino acids 9-50, 60-68, 70-78, 84-100, 105-113, 125-133, 141-153, 186-202, 204-209, 212-219, 236-253, 287-301, 310-317, 319-327, 332-342, 353-358, 364-396, 422-430, 437-459, 484-508, 510-520, 535-543, 573-583, 591-598, 610-621, 629-640, 648-653, 675-685, 691-708, 728-735, 738-745, 750-763, 765-773, 790-797, 799-820, 842-854, 857-864, 880-885, 903-909, 923-933, 939-951, 980-986, 991-998, 1019-1024, 1026-1033, 1045-1051, 1064-1075, 1077-1094, 1100-1115, 1139-1157, 1163-1181, 1196-1202, 1207-1213, 1219-1225, 1241-1250, 1275-1290, 1304-1310, 1332-1347, 1352-1365, 1383-1405, 1421-1429, 1433-1442, 1372-1419 and 979-1467 of Seq ID No 210; amino acids 4-40, 60-65, 90-102, 125-138, 150-160, 162-172 and 14-104 of Seq ID No 211; amino acids 4-31, 37-53, 59-80, 87-93, 173-183, 185-195, 219-233, 239-247, 265-275 and 72-146 of Seq ID No 212; amino acids 5-22, 38-46, 53-58, 69-78, 80-88, 92-99, 117-124, 142-151, 154-165, 189-196, 206-213, 220-226, 288-309, 15-106 and 137-201 of Seq ID No 213; amino acids 4-17, 37-47, 58-66, 75-81, 83-89, 106-116, 145-152, 162-168 and 41-155 of Seq ID No 214; amino acids 4-16, 50-57, 66-72, 92-100, 102-112, 126-150, 156-167, 194-204, 208-218, 244-256 and 165-200 of Seq ID No 215; amino acids 19-26, 38-51, 81-89, 96-103, 107-114, 117-122, 128-134, 150-158, 164-170 and 26-48 of Seq ID No 216; amino acids 5-24, 30-35, 42-47, 74-86, 107-117, 146-156 and 15-92 of Seq ID No 217; amino acids 5-22, 41-49, 55-65, 85-96, 100-106, 111-117, 125-132, 150-155, 161-189, 204-212, 229-243, 262-277, 286-296, 304-311, 314-323, 353-359, 367-373, 391-397, 410-417, 446-451, 485-500, 335-381, 422-484 and 251-528 of Seq ID No 218; amino acids 4-28, 37-43, 65-72, 109-127, 140-148, 155-166, 188-198 and 50-215 of Seq ID No 219; 4-24, 41-55, 71-79, 84-89, 95-100, 113-125, 138-148, 193-203, 215-221, 300-306, 334-350, 362-369, 385-396 and 91-213 of Seq ID No 220; amino acids 4-24, 94-101, 103-112, 128-134, 141-148, 156-165, 172-181, 191-197, 281-290 and 25-76 of Seq ID No 221; amino acids 5-13, 19-25, 27-40, 47-54, 63-69, 84-98, 119-125, 143-158, 170-182, 199-205, 223-234, 237-251, 257-265, 287-292, 296-301, 307-328, 336-352 and 336-362 of Seq ID No 222; amino acids 4-25, 29-36, 41-47, 54-66, 88-95, 97-110, 115-121, 127-135, 164-193, 203-220, 232-244, 269-275, 278-284, 289-316, 320-327, 336-342, 344-353, 355-363, 370-378, 436-442, 449-454, 460-466, 478-489, 492-505 and 311-377 of Seq ID No 223; amino acids 12-34, 40-48, 84-90, 131-138, 140-151, 157-175, 177-187, 193-201, 207-261, 267-281, 306-312, 334-340, 343-349, 352-357, 369-377, 380-394 and 331-386 of Seq ID No 224; amino acids 6-20, 54-73, 97-116, 129-135, 138-149, 173-191, 194-208 and 116-212 of Seq ID No 225; amino acids 11-34, 41-48, 58-72, 82-88, 90-99, 101-109, 137-145, 161-168, 172-188, 193-211, 215-221, 260-269, 271-278, 304-310, 317-327, 336-351 and 208-230 of Seq ID No 226; amino acids 4-13, 20-30, 73-83, 90-107, 117-137, 226-236, 244-260, 268-275, 286-293, 310-317, 324-330, 340-367, 370-379, 390-422, 427-442, 497-505, 507-513, 549-557, 569-576, 585-593, 611-617, 630-638, 647-657, 659-666, 670-675, 689-699, 726-736, 769-774, 779-802, 866-873, 886-894, 934-940, 956-973, 986-992, 1009-1017, 1026-1041, 1043-1050, 1056-1068, 3-48 and 576-739 of Seq ID No 227; amino acids 10-19, 32-40, 42-48, 50-58, 75-85, 88-97, 112-139 and 32-72 of Seq ID No 228; amino acids 4-13, 20-27, 67-80, 92-98, 101-107, 114-123, 153-169, 174-181, 200-206, 213-219, 226-242, 248-254, 256-289, 299-307, 310-316, 320-326, 329-346, 382-392 and 324-391 of Seq ID No 229; amino acids 32-38, 40-47, 49-54, 79-89, 95-101, 110-117, 122-129, 132-140, 151-157, 178-197, 200-206, 216-227, 249-257, 104-143 and 148-195 of Seq ID No 230; amino acids 10-16, 35-47, 52-77, 81-89, 104-109, 115-123, 132-149, 151-160, 163-184, 197-213, 215-245, 252-266, 294-304, 310-337, 342-348, 362-372, 393-398, 408-430, 452-466, 468-476, 485-491, 497-506, 514-520, 530-537, 539-557, 592-606, 627-632, 636-653, 674-688, 693-731, 748-753, 760-766, 783-797, 805-814, 819-825, 833-840, 843-851, 91-135, 282-299 and 445-477 of Seq ID No 231; amino acids 11-22, 25-31, 55-65, 83-107, 111-129 and 130-137 of Seq ID No 232; amino acids 15-21, 24-43, 60-68, 86-95, 157-185, 188-197 and 3-75 of Seq ID No 233; amino acids 13-19, 35-44, 56-73, 79-92, 116-129, 143-158, 169-178, 198-210, 215-221, 238-243, 247-256, 261-267, 270-294, 310-320, 331-341, 360-366, 377-387, 397-406, 412-421, 423-439, 449-455, 458-465, 473-479, 483-492, 510-525, 561-569, 571-597, 599-619, 635-641, 686-704, 712-721, 738-755, 761-767, 781-794, 806-813, 844-857, 862-873, 875-882, 889-896, 901-915, 921-931, 937-943, 963-975, 991-997, 1001-1009, 1025-1032, 1040-1046, 1051-1056, 1073-1080, 1096-1105, 1112-1154, 1163-1170, 1173-1180, 1186-1197, 1203-1208, 1224-1232, 1237-1249, 1254-1261, 400-429 and 521-545 of Seq ID No 234; amino acids 6-30, 81-87, 117-128, 134-142, 147-158, 178-186, 217-227, 246-255 and 61-122 of Seq ID No 235; amino acids 4-22, 31-38, 77-83, 130-137, 159-169, 188-194, 208-229, 231-238, 272-283, 286-294, 308-315, 317-336, 338-347, 8-232 and 265-318 of Seq ID No 236; amino acids 9-23, 26-34, 36-42, 73-94, 113-142, 186-192, 200-221, 232-238, 246-252, 254-279, 292-307, 311-316, 20-62 and 95-181 of Seq ID No 237; amino acids 26-37, 58-67, 83-89, 97-109, 114-141 and 1-76 of Seq ID No 238; amino acids 13-20, 28-35, 70-78, 95-102, 156-169, 171-180 and 121-178 of Seq ID No 239; amino acids 7-20, 32-41, 131-147, 156-166, 219-226, 240-251, 259-270, 275-282, 299-305, 309-315, 336-342, 344-350 and 195-259 of Seq ID No 240; amino acids 7-23, 37-44, 48-63, 93-102, 108-120, 138-145, 219-228, 237-246, 251-270, 277-283, 292-300, 317-323, 336-351, 361-367, 19-124 and 160-232 of Seq ID No 241; amino acids 28-35, 40-47, 93-100, 102-110, 158-182 and 4-77 of Seq ID No 242; amino acids 8-32, 39-44, 104-110, 157-169, 183-196, 212-217 and 42-199 of Seq ID No 243; amino acids 4-18, 49-56, 72-81, 90-107, 127-133, 146-151 and 48-114 of Seq ID No 244; amino acids 4-22, 24-30, 42-53, 57-62, 66-80, 83-90, 99-104, 112-118, 132-148, 168-175, 179-186 and 97-173 of Seq ID No 245; amino acids 7-19, 33-43, 58-77, 85-91 and 14-63 of Seq ID No 246; amino acids 15-21, 24-35, 75-80, 123-128, 133-139, 148-172 and 7-136 of Seq ID No 247; amino acids 29-35, 51-56, 64-74, 82-88, 100-106, 134-153 and 1-44 of Seq ID No 248; amino acids 32-44, 65-72, 75-103, 136-144, 159-166 and 136-185 of Seq ID No 249; amino acids 16-28, 40-53, 74-89, 108-114, 130-140, 152-160, 168-177 and 3-151 of Seq ID No 250; amino acids 5-27, 39-45, 57-65, 72-83, 130-135 and 27-91 of Seq ID No 251; amino acids 16-22, 31-44, 52-67, 79-84, 95-106, 119-127 and 22-78 of Seq ID No 252; amino acids 4-23, 32-39, 45-53, 67-75, 83-89, 97-112, 133-139, 189-194, 200-205, 241-247, 254-259, 275-282, 287-308, 311-316, 329-339, 344-352 and 157-246 of Seq ID No 253; amino acids 4-21, 24-30, 52-77, 81-88, 97-102, 110-115, 125-137 and 70-113 of Seq ID No 254; amino acids 4-20, 33-38, 44-56, 73-81, 123-135, 159-166, 169-181, 199-204 and 13-91 of Seq ID No 255; amino acids 12-18, 23-31, 39-52, 54-60, 63-74, 89-97, 99-111 and 1-66 of Seq ID No 256; amino acids 4-19, 55-62, 76-94, 96-104, 109-126 and 154-166 of Seq ID No 257; amino acids 4-11, 26-39 and 11-19 of Seq ID No 258; amino acids 4-21 and 15-24 of Seq ID No 259; amino acids 12-25 and 23-45 of Seq ID No 260; amino acids 4-23, 33-55, 59-64, 76-93, 107-125, 129-138 and 54-78 of Seq ID No 261; amino acids 4-27, 56-82 and 21-40 of Seq ID No 262; amino acids 8-17, 24-36, 47-61, 76-83 and 65-83 of Seq ID No 263; amino acids 4-22, 37-46, 54-60, 64-70 and 13-25 of Seq ID No 264; amino acids 9-17, 23-41, 64-86, 6-25 and 53-66 of Seq ID No 265; amino acids 4-23, 29-48 and 18-29 of Seq ID No 266; amino acids 9-20, 26-40, 44-51 and 40-60 of Seq ID No 267; amino acids 4-9, 11-18, 20-31 and 4-21 of Seq ID No 268; amino acids 257-278 of Seq ID No 135; amino acids 159-188 and 184-213 of Seq ID No 137; amino acids 230-251 and 247-267 of Seq ID No 138; amino acids 138-164 and 160-187 of Seq ID No 139; amino acids 97-120, 116-139, 135-158 and 154-177 of Seq ID No 140; amino acids 160-187 of Seq ID No 141; amino acids 165-192 and 188-214 of Seq ID No 143; amino acids 350-378 of Seq ID No 144; amino acids 62-86 and 82-106 of Seq ID No 145; amino acids 18-42, 38-62, 78-102, 98-122, 118-142, 138-165, 275-297, 293-315, 185-211, 207-233 and 229-255 of Seq ID No 146; amino acids 22-50, 46-75, 110-131, 127-148, 344-367, 361-384, 382-405 and 401-424 of Seq ID No 147; amino acids 304-328 of Seq ID No 148; amino acids 6-29, 68-92, 88-112, 449-471 and 485-507 of Seq ID No 149; amino acids 937-962, 958-983, 102-130 and 126-154 of Seq ID No 152; amino acids 80-103, 99-122, 118-141 and 137-159 of Seq ID No 153; amino acids 270-299 of Seq ID No 154; amino acids 126-153 and 172-200 of Seq ID No 155; amino acids 15-40, 36-61, 57-82, 78-103 and 99-124 of Seq ID No 156; amino acids 35-63 and 82-109 of Seq ID No 157; amino acids 298-327 of Seq ID No 160; amino acids 20-43, 39-62, 58-79, 354-377, 404-431, 427-453, 449-475, 471-498 and 494-521 of Seq ID No 161; amino acids 40-62, 58-80, 76-97, 251-276, 272-297, 291-316 and 333-358 of Seq ID No 162; amino acids 197-222, 239-264 and 260-284 of Seq ID No 165; amino acids 378-402 and 438-461 of Seq ID No 166; amino acids 82-107, 103-127, 212-235 and 231-253 of Seq ID No 167; amino acids 1053-1082 of Seq ID No 169; amino acids 270-292 of Seq ID No 170; amino acids 44-65, 61-82 and 78-99 of Seq ID No 171; amino acids 1230-1254 of Seq ID No 172; amino acids 110-131 of Seq ID No 173; amino acids 372-395 and 410-434 of Seq ID No 174; amino acids 439-464 of Seq ID No 175; amino acids 52-77 of Seq ID No 176; amino acids 281-300 and 296-316 of Seq ID No 177; amino acids 33-57 and 53-78 of Seq ID No 178; amino acids 718-744, 740-766 and 762-788 of Seq ID No 179; amino acids 66-93, 89-116, 112-139 and 135-161 of Seq ID No 180; amino acids 171-197 of Seq ID No 182; amino acids 102-127, 123-148 and 144-170 of Seq ID No 184; amino acids 91-114 and 110-133 of Seq ID No 187; amino acids 36-60, 56-80, 76-100, 96-119, 343-371 and 367-394 of Seq ID No 188; amino acids 156-183, 179-206, 202-229, 225-252 and 248-274 of Seq ID No 190; amino acids 98-125, 121-148, 144-170, 165-187, 201-223 and 285-309 of Seq ID No 192; amino acids 390-409 of Seq ID No 193; amino acids 6-33, 29-55, 52-79 and 74-100 of Seq ID No 194; amino acids 172-200 and 196-223 of Seq ID No 195; amino acids 12-39, 35-62, 58-84, 156-179 and 175-197 of Seq ID No 196; amino acids 28-53, 49-73, 165-188, 184-207, 203-226, 292-320, 316-344, 531-560, 556-584 and 580-608 of Seq ID No 198; amino acids 200-228 of Seq ID No 200; amino acids 348-374 of Seq ID No 202; amino acids 116-143 and 139-166 of Seq ID No 203; amino acids 203-227 of Seq ID No 204; amino acids 183-208, 204-229 and 225-250 of Seq ID No 206; amino acids 359-384 of Seq ID No 208; amino acids 353-378, 374-399 and 395-419 of Seq ID No 209; amino acids 1372-1398 and 1394-1419 of Seq ID No 210; amino acids 14-38, 34-58 and 54-78 of Seq ID No 211; amino acids 95-122 and 118-146 of Seq ID No 212; amino acids 20-44, 40-64, 60-84, 80-104, 138-162, 158-182 and 178-201 of Seq ID No 213; amino acids 41-67, 63-89, 85-111 and 107-133 of Seq ID No 214; amino acids 165-185 and 181-200 of Seq ID No 215; amino acids 15-44, 40-68 and 64-92 of Seq ID No 217; amino acids 335-360, 356-381, 422-446 and 442-465 of Seq ID No 218; amino acids 50-74, 70-94, 90-114, 110-133, 164-192 and 188-215 of Seq ID No 219; amino acids 91-116, 112-137, 133-158 and 154-179 of Seq ID No 220; amino acids 331-352 of Seq ID No 224; amino acids 116-143, 139-166, 162-189 and 185-212 of Seq ID No 225; amino acids 3-27, 616-640, 636-659, 655-678, 576-598, 594-615, 611-632, 693-718 and 714-739 of Seq ID No 227; amino acids 32-45 of Seq ID No 228; amino acids 112-135, 131-153, 324-349, 345-370 and 366-391 of Seq ID No 229; amino acids 122-143 and 170-195 of Seq ID No 230; amino acids 377-400, 396-419, 91-115 and 111-135 of Seq ID No 231; amino acids 3-27, 23-47, 43-68, 4-30 and 26-52 of Seq ID No 233; amino acids 400-429 and 521-545 of Seq ID No 234; amino acids 61-84, 80-103 and 99-122 of Seq ID No 235; amino acids 8-31, 124-149, 166-191, 207-232, 265-294 and 290-318 of Seq ID No 236; amino acids 20-43, 39-62, 95-122, 117-143, 133-159 and 155-181 of Seq ID No 237; amino acids 1-29 of Seq ID No 238; amino acids 121-143, 139-160 and 156-178 of Seq ID No 239; amino acids 195-219 of Seq ID No 240; amino acids 4-32, 27-54 and 50-77 of Seq ID No 242; amino acids 160-186, 182-208 and 122-149 of Seq ID No 243; amino acids 48-73 and 69-94 of Seq ID No 244; amino acids 151-173 of Seq ID No 245; amino acids 14-41 and 37-63 of Seq ID No 246; amino acids 7-30, 26-49 and 45-69 of Seq ID No 247; amino acids 1-21 and 17-44 of Seq ID No 248; amino acids 43-66 of Seq ID No 250; amino acids 47-71 and 67-91 of Seq ID No 251; amino acids 39-60 and 56-78 of Seq ID No 252; amino acids 199-224 of Seq ID No 253; amino acids 70-94 and 90-113 of Seq ID No 254; amino acids 48-70 of Seq ID No 255; amino acids 1-25, 21-45 and 41-65 of Seq ID No 256; amino acids 27-51 of Seq ID No 257; amino acids 98-125, 144-170, 165-187, 201-223, 285-309, 305-329, 325-348, 400-425, 513-541, 537-564, 560-587 and 583-610 of Seq ID No 192; amino acids 138-164 and 160-187 of Seq ID No 139; amino acids 160-187 of Seq ID No 141; amino acids 350-378, 374-402, 398-426 and 422-451 of Seq ID No 144; amino acids 264-288, 284-308 and 304-328 of Seq ID No 148; amino acids 77-91 of Seq ID No 150; amino acids 111-134 of Seq ID No 151; amino acids 126-153, 149-176 and 172-200 of Seq ID No 155; amino acids 220-245, 241-266 and 262-288 of Seq ID No 158; amino acids 31-53, 49-71 and 67-89 of Seq ID No 159; amino acids 258-280, 276-298, 294-317 and 313-336 of Seq ID No 163; amino acids 458-472 of Seq ID No 164; amino acids 82-107, 103-127, 212-235 and 231-253 of Seq ID No 167; amino acids 26-51 and 47-73 of Seq ID No 168; amino acids 1053-1082 of Seq ID No 169; amino acids 194-217, 213-236, 232-255, 251-274 and 270-292 of Seq ID No 170; amino acids 110-131, 179-201, 197-219 and 215-236 of Seq ID No 173; amino acids 12-36, 32-56 and 52-77 of Seq ID No 176; amino acids 281-300 and 296-316 of Seq ID No 177; amino acids 33-57 and 53-78 of Seq ID No 178; amino acids 171-197, 193-219 and 215-240 of Seq ID No 182; amino acids 363-388, 384-409 and 405-430 of Seq ID No 183; amino acids 102-127, 123-148 and 144-170 of Seq ID No 184; amino acids 149-163 of Seq ID No 185; amino acids 342-366 and 362-386 of Seq ID No 189; amino acids 390-409 of Seq ID No 193; amino acids 50-64 of Seq ID No 197; amino acids 223-249 and 245-272 of Seq ID No 199; amino acids 117-131 of Seq ID No 201; amino acids 116-143 and 139-166 of Seq ID No 203; amino acids 1-21 of Seq ID No 205; amino acids 245-270, 266-291, 287-312 and 308-332 of Seq ID No 207; amino acids 353-378, 374-399 and 395-419 of Seq ID No 209; amino acids 95-122 and 118-146 of Seq ID No 212; amino acids 128-151, 146-169, 314-336, 339-361 and 357-379 of Seq ID No 135; amino acids 159-188 and 184-213 of Seq ID No 137; amino acids 230-251 and 247-267 of Seq ID No 138; amino acids 97-120, 116-139, 135-158 and 154-177 of Seq ID No 140; amino acids 195-228 of Seq ID No 142; amino acids 165-192 and 188-214 of Seq ID No 143; amino acids 6-29, 25-47, 43-65, 68-92, 262-288, 306-331, 326-351, 449-471, 467-489 and 485-507 of Seq ID No 149; amino acids 80-103, 99-122, 118-141 and 137-159 of Seq ID No 153; amino acids 15-40, 36-61, 57-82, 78-103, 99-124 and 120-146 of Seq ID No 156; amino acids 35-63, 59-86, 187-213, 209-235 and 252-277 of Seq ID No 157; amino acids 83-108, 104-129, 125-150, 146-172, 272-302 and 298-327 of Seq ID No 160; amino acids 197-222, 218-243, 239-264 and 260-284 of Seq ID No 165; amino acids 378-402, 398-422, 418-442 and 438-461 of Seq ID No 166; amino acids 44-65, 61-82 and 78-99 of Seq ID No 171; amino acids 1230-1254 and 150-1275 of Seq ID No 172; amino acids 372-395, 391-414 and 410-434 of Seq ID No 174; amino acids 439-464 of Seq ID No 175; amino acids 718-744, 740-766, 762-788, 906-931, 927-951 and 947-971 of Seq ID No 179; amino acids 66-93, 135-161 and 494-518 of Seq ID No 180; amino acids 40-61, 57-79 and 75-97 of Seq ID No 181; amino acids 440-462, 458-480 and 476-497 of Seq ID No 186; amino acids 91-114, 110-133, 129-152 and 148-170 of Seq ID No 187; amino acids 156-183, 179-206, 202-229, 225-252 and 248-274 of Seq ID No 190; amino acids 747-773 and 769-795 of Seq ID No 191; amino acids 6-33, 29-55, 52-79 and 74-100 of Seq ID No 194; amino acids 148-176, 172-200 and 196-223 of Seq ID No 195; amino acids 28-53, 49-73, 165-188, 203-226, 292-320, 316-344 and 531-560 of Seq ID No 198; amino acids 180-208 and 200-228 of Seq ID No 200; amino acids 203-227, 223-247, 243-267 and 263-287 of Seq ID No 204; amino acids 339-363 and 359-384 of Seq ID No 208; amino acids 1372-1398 of Seq ID No 210; amino acids 14-38, 34-58, 74-98 and 94-117 of Seq ID No 211; amino acids 41-67, 63-89 and 129-155 of Seq ID No 214; amino acids 165-185 and 181-200 of Seq ID No 215; amino acids 26-44 of Seq ID No 216; amino acids 15-44, 40-68 and 64-92 of Seq ID No 217; amino acids 90-114, 110-133, 140-168, 164-192 and 188-215 of Seq ID No 219; amino acids 91-116, 112-137, 133-158 and 154-179 of Seq ID No 220; amino acids 311-338, 334-361, 357-385, 381-409 and 405-433 of Seq ID No 223; amino acids 331-352, 348-369 and 365-386 of Seq ID No 224; amino acids 116-143, 139-166, 162-189 and 185-212 of Seq ID No 225; amino acids 208-230 of Seq ID No 226; amino acids 32-45 and 50-72 of Seq ID No 228; amino acids 131-153, 149-172, 324-349, 345-370 and 366-391 of Seq ID No 229; amino acids 104-126, 122-143, 148-174 and 170-195 of Seq ID No 230; amino acids 91-115, 111-135, 377-400, 396-419, 532-553, 548-569, 715-744 and 740-768 of Seq ID No 231; amino acids 3-27, 23-47 and 43-68 of Seq ID No 233; amino acids 118-141, 137-160 and 521-545 of Seq ID No 234; amino acids 4-30, 26-52 and 48-75 of Seq ID No 233; amino acids 61-84, 80-103 and 99-122 of Seq ID No 235; amino acids 20-43, 39-62, 95-122 and 117-143 of Seq ID No 237; amino acids 195-219, 215-239 and 235-259 of Seq ID No 240; amino acids 27-54 of Seq ID No 242; amino acids 197-217 and 213-232 of Seq ID No 241; amino acids 48-73, 69-94 and 90-114 of Seq ID No 244; amino acids 133-159 and 155-181 of Seq ID No 237; amino acids 14-41 and 37-63 of Seq ID No 246; amino acids 29-52 and 48-70 of Seq ID No 255; amino acids 1-29, 24-53 and 49-76 of Seq ID No 238; amino acids 1-21 and 17-44 of Seq ID No 248; amino acids 122-149 and 145-172 of Seq ID No 243; amino acids 3-27, 23-47, 43-66, 62-85, 136-165, 156-185, 81-107 and 103-129 of Seq ID No 249; amino acids 160-186 and 182-208 of Seq ID No 243; amino acids 27-51 and 47-72 of Seq ID No 257; amino acids 177-191 of Seq ID No 136; amino acids 27-51, 47-71 and 67-91 of Seq ID No 251; amino acids 7-30, 26-49, 45-69 and 65-89 of Seq ID No 247; amino acids 126-137 of Seq ID No 232; amino acids 22-43, 39-60 and 56-78 of Seq ID No 252; amino acids 693-718, 714-739, 438-460, 456-477, 473-495, 806-828, 824-846, 616-640, 636-659, 655-678, 674-697, 576-598, 594-615, 611-632, 851-877, 873-898, 731-760, 756-784, 3-27, 23-48, 957-982 and 978-1002 of Seq ID No 227; amino acids 157-182, 178-203, 199-224 and 220-246 of Seq ID No 253; amino acids 70-94 and 90-113 of Seq ID No 254; amino acids 20-44, 40-64, 60-84, 80-104, 138-162, 158-182 and 178-201 of Seq ID No 213; amino acids 1-25, 21-45 and 41-65 of Seq ID No 256; amino acids 121-143, 139-160 and 156-178 of Seq ID No 239; amino acids 12-39, 35-62, 58-84 and 175-197 of Seq ID No 196; amino acids 18-42, 38-62, 58-82, 78-102, 98-122, 118-142, 138-165, 256-279, 275-297, 293-315, 163-189, 185-211, 207-233 and 229-255 of Seq ID No 146; amino acids 46-75, 110-131, 127-148, 188-216, 212-240, 344-367, 361-384, 382-405 and 401-424 of Seq ID No 147; amino acids 151-180, 176-205, 245-274 and 270-299 of Seq ID No 154; amino acids 937-962, 958-983, 102-130, 126-154, 150-177, 823-849, 845-872, 867-892, 285-314, 310-339 and 335-364 of Seq ID No 152; amino acids 97-119, 115-137, 133-155 and 151-173 of Seq ID No 245; amino acids 20-43, 39-62, 58-79, 69-94, 90-115, 167-189, 185-207, 203-224, 296-320, 316-339, 335-358, 354-377, 404-431, 427-453, 449-475, 471-498 and 494-521 of Seq ID No 161; amino acids 40-62, 76-97, 251-276, 272-297, 291-316 and 333-358 of Seq ID No 162; amino acids 335-360, 356-381, 422-446, 442-465 and 461-484 of Seq ID No 218; amino acids 46-69, 65-88, 84-107, 124-149, 186-211, 207-232, 265-294 and 290-318 of Seq ID No 236; amino acids 56-80, 76-100, 96-119, 343-371, 367-394, 410-436 and 432-457 of Seq ID No 188; amino acids 281-307 and 631-654 of Seq ID No 202; amino acids 41-66, 62-86, 82-106, 102-126, 417-444, 440-466, 528-554, 550-575 and 571-596 of Seq ID No 145.

In an embodiment of the eighth aspect the antigen further consists of
a) 1 to 50 additional amino acid residue(s), preferably 1 to 40, more preferably 1 to 30, even more preferably at most 1 to 25, still more preferably at most 1 to 10, most preferably 1, 2, 3, 4 or 5 additional amino acid residue (s); and/or
b) at least one amino acid residue heterologous to the core amino acid sequence.

In an embodiment of the eighth aspect the amino acid residue(s) is/are flanking the core amino acid sequence C-terminally, N-terminally or C- and N-terminally.

In an embodiment of the eighth aspect the antigen comprises at least 2, preferably at least 3 core amino acid sequences as defined in the eighth aspect.

In a further embodiment the antigen, preferably encoded by said nucleic acids of the present invention, is a functional or active fragment and/or a functional or active variant of said antigen. In a still further preferred embodiment the functional or active fragment and/or the functional or active variant is as defined herein.

The problem underlying the present invention is solved in a ninth aspect by a process for producing a protein, a hyperimmune serum reactive antigen or an antigen, or a fragment thereof, as defined in the fifth, sixth, seventh or eighth aspect, comprising expressing the nucleic acid molecule as defined in the first or the second aspect.

The problem underlying the present invention is solved in a tenth aspect by a process for producing a cell which expresses a protein, a hyperimmune reactive serum antigen or an antigen, or a fragment thereof, as defined in the fifth, sixth, seventh or eighth aspect comprising transforming or transfecting a suitable host cell with the vector as defined in the third aspect.

In an embodiment of the ninth and tenth aspect the protein, the hyperimmune reactive serum antigen or the antigen, or the fragment thereof, is a protein, a hyperimmune reactive serum antigen or an antigen, or a fragment thereof, from *Borrelia burgdorferi* s.s., *Borrelia garinii*, *Borrelia afzelii*, *Borrelia andersonii*, *Borrelia bissettii*, *Borrelia valaisiana*, *Borrelia lusitaniae*, *Borrelia spielmani*, *Borrelia japonica*, *Borrelia tanukii*, *Borrelia turdae* or *Borrelia sinica* antigen, preferably from *Borrelia burgdorferi* s.s., *Borrelia afzelii* or *Borrelia garinii*.

The problem underlying the present invention is solved in an eleventh aspect by a pharmaceutical composition, preferably a vaccine, comprising a protein, a hyperimmune reactive serum antigen or an antigen, or a fragment thereof, as defined in the fifth, sixth, seventh or eighth aspect or a nucleic acid molecule as defined in the first or the second aspect or a vector as defined in the third aspect.

In a preferred embodiment the pharmaceutical composition of the present invention further comprises an immunostimulatory substance, preferably selected from the group comprising polycationic polymers, more preferably polycationic peptides, immunostimulatory deoxynucleotides (ODNs), peptides containing at least two LysLeuLys motifs, preferably KLKLLLLLKLK (SEQ ID NO:751), neuroactive compounds, more preferably human growth hormone, alum, Freund's complete or incomplete adjuvants or combinations thereof.

In a more preferred embodiment of the pharmaceutical composition of the present invention the immunostimulatory substance is a combination of either a polycationic polymer and immunostimulatory deoxynucleotides or of a peptide containing at least two LysLeuLys motifs and immunostimulatory deoxynucleotides.

In a still more preferred embodiment of the pharmaceutical composition of the present invention the polycationic polymer is a polycationic peptide, especially polyarginine.

The problem underlying the present invention is solved in a twelfth aspect by the use of a nucleic acid molecule as defined in the first or the second aspect or of a protein, a hyperimmune reactive serum antigen or an antigen, or fragment thereof, as defined in the fifth, sixth, seventh or eighth aspect for the manufacture of a pharmaceutical preparation or medicament, especially for the manufacture of a vaccine against *Borrelia burgdorferi* s.s., *Borrelia garinii*, *Borrelia afzelii*, *Borrelia andersonii*, *Borrelia bissettii*, *Borrelia valaisiana*, *Borrelia lusitaniae*, *Borrelia spielmani*, *Borrelia japonica*, *Borrelia tanukii*, *Borrelia turdae* and *Borrelia sinica*, preferably a vaccine against *Borrelia burgdorferi* s.s., *Borrelia afzelii* or *Borrelia garinii*.

The problem underlying the present invention is solved in a thirteenth aspect by an antibody, or at least an effective part thereof, which binds to at least a selective part of a protein, a hyperimmune reactive serum antigen or an antigen, or a fragment thereof, preferably an active fragment thereof, or a variant thereof, preferably an active variant thereof, as defined in the fifth, sixth, seventh or eighth aspect.

In an embodiment of the thirteenth aspect the antibody is a monoclonal antibody.

In an embodiment of the thirteenth aspect said effective part comprises a Fab fragment, a F(ab) fragment, a F(ab) N fragment, a F(ab)$_2$ fragment or a F$_v$ fragment.

In an embodiment of the thirteenth aspect the antibody is a chimeric antibody.

In an embodiment of the thirteenth aspect the antibody is a humanized antibody.

The problem underlying the present invention is solved in a fourteenth aspect by a hybridoma cell line, which produces an antibody as defined in the thirteenth aspect.

The problem underlying the present invention is solved in a fifteenth aspect by a method for producing an antibody as defined in the thirteenth aspect, characterized by the following steps:
   a) initiating an immune response in a non-human animal by administrating a protein, a hyperimmune reactive serum antigen or an antigen, or a fragment thereof, as defined in the fifth, sixth, seventh or eighth aspect, to said animal,
   b) removing an antibody containing body fluid from said animal, and
   c) producing the antibody by subjecting said antibody containing body fluid to further purification steps.

The problem underlying the present invention is solved in a sixteenth aspect by a method for producing an antibody as defined in the thirteenth aspect, characterized by the following steps:
   a) initiating an immune response in a non-human animal by administrating a protein, a hyperimmune reactive serum antigen or an antigen, or a fragment thereof, as defined in the fifth, sixth, seventh or eighth aspect, to said animal,
   b) removing the spleen or spleen cells from said animal,
   c) producing hybridoma cells of said spleen or spleen cells,
   d) selecting and cloning hybridoma cells specific for said protein, hyperimmune reactive serum antigen or antigen, or a fragment thereof,
   e) producing the antibody by cultivation of said cloned hybridoma cells and optionally further purification steps.

The problem underlying the present invention is solved in a seventeenth aspect by the use of an antibody as defined in the thirteenth aspect for the preparation of a medicament for treating or preventing infections with *Borrelia*, preferably pathogenic *Borrelia*, more preferably *Borrelia burgdorferi* s.s., *Borrelia garinii*, *Borrelia afzelii*, *Borrelia andersonii*, *Borrelia bissettii*, *Borrelia valaisiana*, *Borrelia lusitaniae*, *Borrelia spielmani*, *Borrelia japonica*, *Borrelia tanukii*, *Borrelia turdae* and *Borrelia sinica*, and most preferably with *Borrelia burgdorferi* s.s., *Borrelia afzelii* or *Borrelia garinii*.

According to another aspect the present invention provides an antagonist, which binds or is capable of binding to a protein, hyperimmune reactive antigen or antigen, or an active fragment or active variant thereof as disclosed in the present invention. According to a still further aspect the antagonist according to the present invention is an antagonist which is capable of reducing or inhibiting the interaction activity of a protein, a hyperimmune serum-reactive antigen or an antigen, or an active fragment thereof or an active variant thereof; according to the present invention to its interaction partner. Such interaction partner is, in a preferred embodiment, an antibody or a receptor, preferably a physiological receptor, of said protein, hyperimmune serum-reactive antigen and/or antigen, or an active fragment thereof or an active variant thereof.

The problem underlying the present invention is solved in an eighteenth aspect by a method for identifying an antagonist capable of binding to a protein, a hyperimmune reactive serum antigen or an antigen, or a fragment thereof, as defined in the fifth, sixth, seventh or eighth aspect, comprising:
   a) contacting an isolated or immobilized protein, hyperimmune reactive serum antigen or antigen, or a fragment thereof, as defined in the fifth, sixth, seventh or eighth aspect with a candidate antagonist under conditions to permit binding of said candidate antagonist to said protein, hyperimmune reactive serum antigen or antigen, or fragment thereof; in the presence of a component capable of providing a detectable signal in response to the binding of the candidate antagonist to said protein, hyperimmune reactive serum antigen or antigen, or fragment thereof; and
   b) detecting the presence or absence of a signal generated in response to the binding of the antagonist to said protein, hyperimmune reactive serum antigen or antigen, or fragment thereof.

The problem underlying the present invention is solved in a nineteenth aspect by a method for identifying an antagonist capable of reducing or inhibiting the interaction activity of a protein, a hyperimmune reactive serum antigen or an antigen, or a fragment thereof, according to the fifth, sixth, seventh or eighth aspect to its interaction partner comprising:
   a) providing a protein, a hyperimmune reactive serum antigen or an antigen, or a fragment thereof; as defined in the fifth, sixth, seventh or eighth aspect,
   b) providing an interaction partner to said protein, hyperimmune reactive serum antigen or antigen, or fragment thereof; especially an antibody according to the thirteenth aspect,
   c) allowing interaction of said protein, hyperimmune reactive serum antigen or antigen, or fragment thereof, to said interaction partner to form an interaction complex,
   d) providing a candidate antagonist,
   e) allowing a competition reaction to occur between the candidate antagonist and the interaction complex,
   f) determining whether the candidate antagonist inhibits or reduces the interaction activities of the protein, hyperimmune reactive serum antigen or antigen, or fragment thereof, with the interaction partner.

The problem underlying the present invention is solved in a twentieth aspect by use of any of the protein, hyperimmune reactive serum antigen or antigen, or a fragment thereof, as defined in the fifth, sixth, seventh or eighth aspect for the isolation and/or purification and/or identification of an interaction partner of said protein, hyperimmune reactive serum antigen or antigen, or fragment thereof.

The problem underlying the present invention is solved in a twenty-first aspect by a method for diagnosing an infection with a *Borrelia* organism comprising the steps of:
a) contacting a sample obtained from a subject with the protein, hyperimmune serum reactive antigen or antigen, or any fragment thereof, as defined in the fifth, sixth, seventh or eighth aspect; and
b) detecting the presence of an antibody against said *Borrelia* organism in the sample.

The problem underlying the present invention is solved in a twenty-second aspect by a method for diagnosing an infection with a *Borrelia* organism comprising the steps of:
a) contacting a sample obtained from a subject with a primer or a probe specific for a nucleic acid molecule, or a fragment thereof, as defined in the first or the second aspect; and
b) detecting the presence of such nucleic acid molecule or fragment thereof in the sample.

The present invention also provides a process for in vitro diagnosing a disease related to expression of a hyperimmune serum-reactive antigen or a fragment thereof according to the present invention comprising determining the presence of a nucleic acid sequence encoding said hyperimmune serum reactive antigen or fragment thereof according to the present invention or the presence of the hyperimmune serum reactive antigen or fragment thereof according to the present invention.

The problem underlying the present invention is solved in a twenty-third aspect by a method for diagnosing an infection with a *Borrelia* organism comprising the steps of:
a) contacting a sample obtained from a subject with the antibody according to the thirteenth aspect; and
b) detecting the presence of an antigen of said *Borrelia* organism in the sample.

In an embodiment of the twenty-third aspect the antigen of said *Borrelia* organism is a protein, hyperimmune serum reactive antigen or antigen as defined in the fifth, sixth, seventh or eighth aspect.

In an embodiment of the twenty-first, twenty-second and twenty-third aspect the *Borrelia* organism is a pathogenic *Borrelia* organism, more preferably a *Borrelia* organism selected from the group comprising *Borrelia burgdorferi Borrelia garinii, Borrelia afzelii, Borrelia andersonii, Borrelia bissettii, Borrelia valaisiana, Borrelia lusitaniae, Borrelia spielmani, Borrelia japonica, Borrelia tanukii, Borrelia turdae* and *Borrelia sinica*, and even more preferably selected from the group comprising *B. burgdorferi* s.s., *B. afzelii* and *B. garinii*.

Moreover, the present invention provides the use of a protein, a hyperimmune serum reactive antigen or an antigen, or a fragment thereof or a variant thereof, as defined in the present invention for the generation of a peptide binding to said protein, hyperimmune serum reactive antigen or antigen, or a fragment thereof or a variant thereof, wherein the peptide is an anticaline.

The problem underlying the present invention is solved in a twenty-fourth aspect by use of a protein, a hyperimmune reactive serum antigen or an antigen, or fragment thereof, as defined in the fifth, sixth, seventh or eighth aspect for the manufacture of a functional nucleic acid, wherein the functional nucleic acid is selected from the group comprising aptamers and spiegelmers.

The problem underlying the present invention is solved in a twenty-fifth aspect by use of a nucleic acid molecule as defined in the first or the second aspect for the manufacture of a functional ribonucleic acid, wherein the functional ribonucleic acid is selected from the group comprising ribozymes, antisense nucleic acids and siRNA.

The problem underlying the present invention is solved in a twenty-sixth aspect by a method for the treatment of a *Borrelia* infection in an animal or man preferably in need thereof, comprising the step of administering to said animal or man a therapeutically effective amount of a pharmaceutical composition or a medicament as defined in any of the preceding aspects or an antibody as defined in the thirteenth aspect.

In an embodiment of the twenty-sixth aspect the *Borrelia* infection is an infection with *Borrelia burgdorferi* s.s., *Borrelia garinii, Borrelia afzelii, Borrelia andersonii, Borrelia bissettii, Borrelia valaisiana, Borrelia lusitaniae, Borrelia spielmani, Borrelia japonica, Borrelia tanukii, Borrelia turdae* or *Borrelia sinica*, preferably *Borrelia burgdorferi* s.s., *Borrelia afzelii* or *Borrelia garinii*.

The problem underlying the present invention is solved in a twenty-seventh aspect by a method for immunizing an animal or man against infection with a *Borrelia* organism, comprising the step of administering to said animal or man an effective amount of the protein, the hyperimmune reactive serum antigen or the antigen, or a fragment thereof, as defined in the fifth, sixth, seventh or eighth aspect, or of the nucleic acid molecule as defined in the first or the second aspect or a vector as defined in the third aspect, wherein the effective amount is suitable to elicit an immune response in said animal or man.

In an embodiment of the twenty-seventh aspect the *Borrelia* organism is selected from the group comprising *Borrelia burgdorferi* s.s., *Borrelia garinii, Borrelia afzelii, Borrelia andersonii, Borrelia bissettii, Borrelia valaisiana, Borrelia lusitaniae, Borrelia spielmani, Borrelia japonica, Borrelia tanukii, Borrelia turdae* and *Borrelia sinica*, preferably *Borrelia burgdorferi* s.s., *Borrelia afzelii* or *Borrelia garinii*.

The problem underlying the present invention is solved in a twenty-eighth aspect by a method for stimulating an immune response in an animal or man against a *Borrelia* organism, comprising the step of administering to said animal or man an effective amount of the protein, the hyperimmune reactive serum antigen or the antigen, or a fragment thereof, as defined in the fifth, sixth, seventh or eighth aspect, or of the nucleic acid molecule as defined in the first or the second aspect or a vector as defined in the third aspect, wherein the effective amount is suitable to stimulate the immune response in said animal or man.

In an embodiment of the twenty-eighth aspect the *Borrelia* organism is selected from the group comprising *Borrelia burgdorferi* s.s., *Borrelia garinii, Borrelia afzelii, Borrelia andersonii, Borrelia bissettii, Borrelia valaisiana, Borrelia lusitaniae, Borrelia spielmani, Borrelia japonica, Borrelia tanukii, Borrelia turdae* and *Borrelia sinica*, preferably *Borrelia burgdorferi* s.s., *Borrelia afzelii* or *Borrelia garinii*.

It is within the present invention that the various methods and uses, respectively, where a protein, a hyperimmune serum reactive antigen or an antigen, as defined in the present invention is used, can also be performed or practiced using a fragment of such protein, hyperimmune serum reactive antigen or antigen, preferably an active fragment thereof, or a variant of such protein, hyperimmune serum reactive antigen or antigen, preferably an active variant thereof, each as preferably described herein. It is also within the present invention that the various kinds of compounds disclosed herein as interacting with or targeting the protein, the hyperimmune serum-reactive antigen and/or the antigen according to the present invention, can additionally or alternatively interact with or target the active fragment or active variant of said protein, hyperimmune serum reactive antigen or antigen.

It is also within the present invention that each and any method in the practice of which an antibody is used, can, in principle, also be practiced when instead of the antibody the anticalines or the functional nucleic acids as defined herein are used, whereby it is preferred that such functional nucleic acid is selected from the group comprising aptamers and spiegelmers. This applies equally to the various uses of the present application.

In a preferred embodiment a fragment of a protein, hyperimmune serum reactive antigen or antigen, each as disclosed herein, is a part of such protein, hyperimmune serum reactive antigen or antigen which exhibits at least one feature of such protein, hyperimmune serum reactive antigen or antigen. Preferably such feature is a feature selected from the group comprising treatment of infections, immunization of an animal including man, and stimulation of an immune response in an animal including man.

It is also within the present invention that any disclosure made herein in relation to *Borrelia* and more specifically *Borrelia burgdorferi* s.l. is equally applicable to a *Borrelia* species, whereby the *Borrelia* species is preferably selected from the group comprising *Borrelia burgdorferi* s.s., *Borrelia garinii*, *Borrelia afzelii*, *Borrelia andersonii*, *Borrelia bissettii*, *Borrelia valaisiana*, *Borrelia lusitaniae*, *Borrelia spielmani*, *Borrelia japonica*, *Borrelia tanukii*, *Borrelia turdae* and *Borrelia sinica*.

As preferably used herein the term polypeptide according to the present invention refers in a comprehensive manner to the protein, hyperimmune serum reactive antigen or antigen according to the present invention, including each and any variant, fragment, analogue or derivative thereof, particularly as described herein. Insofar, whenever the term polypeptide is used herein, and if not explicitly stated otherwise, the respective disclosure is also made for or in relation to any protein, hyperimmune serum reactive antigen or antigen according to the present invention, including each and any variant, fragment, analogue or derivative thereof, particularly as described herein. Also it is to be understood that any use or aspect described in connection with any of the above mentioned compounds covered by the term polypeptide according to the present invention shall be applicable also to each and any other of the above mentioned compounds covered by the term polypeptide according to the present invention.

The present invention advantageously provides an efficient, relevant and comprehensive set of isolated nucleic acid molecules and proteins, hyperimmune reactive antigens or antigens encoded by them, including the active fragments and the active variants thereof, using an antibody preparation from multiple human plasma pools and surface expression libraries derived from the genome of *B. burgdorferi* s.l. Thus, the present invention fulfils a widely felt demand for *B. burgdorferi* s.l. antigens, vaccines, diagnostics and products useful in procedures for preparing antibodies and for identifying compounds effective against infections caused by pathogenic *Borrelia* species, preferably the *Borrelia* species described in Table A herein, more preferably *B. burgdorferi* s.s., *B. afzelii* or *B. garinii*.

An effective vaccine should be composed of proteins or polypeptides, which are expressed by all strains and are able to induce high affinity, abundant antibodies against cell surface components of said pathogenic *Borrelia* species, including *B. burgdorferi* s.s., *B. afzelii* or *B. garinii*. The antibodies should be IgG1 and/or IgG3 for opsonization, and any IgG subtype for neutralisation of adherence and toxin action. A chemically defined vaccine must be definitely superior compared to a whole cell vaccine (attenuated or killed), since components of said pathogenic *Borrelia* species, including *B. burgdorferi* s.s., *B. afzelii* or *B. garinii*, which cross-react with human tissues or inhibit opsonization can be eliminated, and the individual proteins inducing protective antibodies and/or a protective immune response can be selected.

In a preferred embodiment of the present invention, the nucleic acid molecules exhibit 70% identity over their entire length to a nucleotide sequence set forth in Seq ID Nos 1 to 134, 269 to 387 or 507 to 628. More preferred are nucleic acids that comprise a region that is at least 80% or at least 85% identical over their entire length to a nucleic acid molecule set forth in Seq ID Nos 1 to 134, 269 to 387 or 507 to 628. In this regard, nucleic acid molecules at least 90%, 91%, 92%, 93%, 94%, 95%, or 96% identical over their entire length to the same are particularly preferred. Furthermore, those with at least 97% are highly preferred, those with at least 98% and at least 99% are particularly highly preferred, with at least 99% or 99.5% being the more preferred, with 100% identity being especially preferred. Moreover, preferred embodiments in this respect are nucleic acids, which encode proteins, hyperimmune serum reactive antigens or antigens, or fragments thereof (polypeptides) which retain substantially the same biological function or activity as the mature polypeptide encoded by said nucleic acids set forth in the Seq ID Nos 135 to 268, 388 to 506 or 629 to 750. It is also within the present invention that the nucleic acid molecules according to the present invention are coding for a protein which is preferably a hyperimmune serum reactive antigen or an antigen. Still further it is within the present invention that the molecules encoded by Seq ID Nos 135 to 268, 388 to 506 or 629 to 750 are proteins, which are preferably antigens or hyperimmune serum reactive antigens.

Identity, as known in the art and used herein, is the relationship between two or more polypeptide sequences or two or more polynucleotide sequences, as determined by comparing the sequences. In the art, identity also means the degree of sequence relatedness between polypeptide or polynucleotide sequences, as the case may be, as determined by the match between strings of such sequences. Identity can be readily calculated. While there exist a number of methods to measure identity between two polynucleotide or two polypeptide sequences, the term is well known to skilled artisans (e.g. *Sequence Analysis in Molecular Biology*, von Heinje, G., Academic Press, 1987). Preferred methods to determine identity are designed to give the largest match between the sequences tested. Methods to determine identity are codified in computer programs. Preferred computer program methods to determine identity between two sequences include, but are not limited to, GCG program package (Devereux, J. et al., 1984), BLASTP, BLASTN, and FASTA (Altschul, S. et al., 1990).

The nucleic acid molecules according to the present invention can, as a second alternative to the nucleic acid molecules described herein by reference to Seq ID Nos, the description of which is also referred to herein as first alternative, also be nucleic acid molecules, which are at least essentially complementary to the nucleic acids described in accordance with the first alternative herein. It will be acknowledged by the ones skilled in the art that an individual nucleic acid molecule is at least essentially complementary to another individual nucleic acid molecule. As used herein complementary means that a nucleic acid strand is base pairing via Watson-Crick base pairing with a second nucleic acid strand. Essentially complementary as used herein means that the base pairing is not occurring for all of the bases of the respective strands but leaves a certain number or percentage of the bases unpaired or wrongly paired. The percentage of correctly pairing bases is preferably at least 70%, more preferably 80%, even more preferably 90% and most preferably any percentage higher than 90%. Such higher percentage includes 91, 92, 93, 94, 95, 96, 97, 98, 99 and 100%, whereby such definition is applicable to each aspect of the present application where this kind of terminology is used. It is to be noted that a percentage of 70% matching bases is considered as homology and the hybridisation having this extent of matching base pairs is considered as stringent. Hybridisation conditions for this kind of stringent hybridisation may be taken from Current Protocols in Molecular Biology (John Wiley and Sons, Inc., 1987). More particularly, the hybridisation conditions can be as follows:

a) Hybridisation performed e.g. in 5×SSPE, 5×Denhardt's reagent, 0.1% SDS, 100 g/mL sheared DNA at 68° C.
b) Moderate stringency wash in 0.2×SSC, 0.1% SDS at 42° C.
c) High stringency wash in 0.1×SSC, 0.1% SDS at 68° C.

Genomic DNA with a GC content of 50% has an approximate $T_M$ of 96° C. For 1% mismatch, the $T_M$ is reduced by approximately 1° C.

In addition, any of the further hybridisation conditions described herein are in principle applicable as well.

Of course, all nucleic acid sequence molecules which encode the same polypeptide molecule as those identified by the present invention are encompassed by any disclosure of a given coding sequence, since the degeneracy of the genetic code is directly applicable to unambiguously determine all possible nucleic acid molecules which encode a given polypeptide molecule, even if the number of such degenerated nucleic acid molecules may be high. This is also applicable for active fragments or active variants of a given polypeptide, protein, hyperimmune serum reactive antigen or antigen, as long as the fragments or variant encode a polypeptide, protein, hyperimmune serum reactive antigen or antigen being suitable to be used such that the same effect can be obtained as if the full-length polypeptide, protein, hyperimmune serum reactive antigen or antigen was used, preferably may be used in a vaccination connection, e.g. as an active or passive vaccine.

The nucleic acid molecule according to the present invention can, as a third alternative, also be a nucleic acid which comprises a stretch of at least 15 bases of the nucleic acid molecule according to the first or second alternative of the nucleic acid molecules according to the present invention as outlined above. Preferably, the bases form a contiguous stretch of bases. However, it is also within the scope of the present invention that the stretch consists of two or more moieties, which are separated by a number of bases.

The nucleic acid molecules according to the present invention may preferably consist of at least 20, even more preferred at least 30, especially at least 50 contiguous bases from the sequences disclosed herein. The suitable length may easily be optimized due to the intended field of use (e.g. as (PCR) primers, probes, capture molecules (e.g. on a (DNA) chip), etc.). Preferred nucleic acid molecules contain at least a contiguous 15 base portion of one or more of the immunogenic amino acid sequences listed in tables 1, 5 and 6. Specifically preferred are nucleic acids containing a contiguous portion of a DNA sequence of any sequence contained in the sequence protocol of the present application which shows 1 or more, preferably more than 2, especially more than 5, non-identical nucleic acid residues compared to the *B. burgdorferi* s.s. and *B. garinii* genomes and plasmids as specified in the following by their NCBI accession numbers and plasmid designation (variable plasmid segments; VPS):

*B. burgdorferi* s.s. (B31), NC_001318 (linear chromosome), NC_000957 (lp5), NC_000956 (lp56), NC_000953 (cp32-8), NC_000952 (cp32-7), NC_000951 (cp32-6), NC_000950 (cp32-4), NC_000949 (cp32-3), NC_000948 (cp32-1), NC_000955 (lp21), NC_000954 (cp32-9), NC_001904 (cp9), NC_001903 (cp26), NC_001851 (lp28-1), NC_001857 (lp54), NC_001856 (lp38), NC_001855 (lp36), NC_001854 (lp28-4), NC_001853 (lp28-3), NC_001852 (lp28-2), NC 001850 (lp25), NC 001849 (lp17); *B. garinii* (PBi), NC_006156 (linear chromosome), NC_006128 (cp26), NC 006129 (lp54), NT_108263 (VPS G11a15f12.s1), NT_108262 (VPS G1M1b11b03.s1), NT_108261 (VPS G1M1b15c06.r1), NT_108260 (VPS G11a14d08.s1), NT_108259 (VPS PBi11a03e01.s1), NT_108258 (VPS G1a13d03.r1), NT_108257 (VPS G1Mb19g09.r1), NT_108256 (VPS G11a19d04.r1), NT_108255 (VPS G1a13d06.s1), NT_108254 (VPS G1a18e10.s1), NT_108253 (VPS G1a22b07.r1), NT_108252 (VPS G11a15h12.r1), NT_108251 (VPS G1a18d09.s1), NT_108250 (VPS G1a07g11.r1), NT_108249 (VPS G1Mb28a10.r1), NT_108248 (VPS G1a23g09.r1), NT_108247 (VPS PBi1M1b05c04.r1), NT_108246 (VPS G1M1b09a03.r1), NT_108245 (VPS G1a10e03.r1), NT_108244 (VPS G1Mb12b07.s1), NT_108243 (VPS G1a25a05.r1), NT_108242 (VPS G11a16g12.s1), NT_108241 (VPS G11a 14a06.r1), NT_108240 (VPS G1a34d11.r1), NT_108239 (VPS G1a19c04.r1), NT_108238 (VPS G1Mb03b12.r1), NT_108237 (VPS G11a16d07.r1), NT_108236 (VPS G1a09h07.r1), NT_108235 (VPS G1a07d05.r1), NT_108234 (VPS G1M1b07c12.s1), NT_108233 (VPS G11a15e03.s1), NT_108232 (VPS G1M1b09g01.s1), NT_108231 (VPS G1a34h09.s1), NT_108230 (VPS G1a08d08.s1), NT_108229 (VPS G1M1b13a11.r1), NT_108228 (VPS G11a17h03.s1, NT_108227 (VPS G1a19d06.s1).

Specifically preferred non-identical nucleic acid residues are residues, which lead to a non-identical amino acid residue. Preferably, the nucleic acid sequences encode polypeptides, proteins, hyperimmune serum reactive antigens or antigens having at least 1, preferably at least 2, preferably at least 3 different amino acid residues compared to the published or listed *B. burgdorferi* s.l. counterparts mentioned above. Preferably, this kind of polypeptides, proteins, hyperimmune serum reactive antigens or antigens still has at least one of the characteristics of the molecules disclosed herein having identical amino acid residues. Also such isolated polypeptides, being fragments of the proteins (or the whole protein), hyperimmune serum reactive antigens or antigens disclosed herein e.g. in the sequence listing, having at least 6, 7, or 8 amino acid residues and being encoded by these nucleic acids, are preferred.

The nucleic acid molecule according to the present invention can, as a fourth alternative, also be a nucleic acid molecule which anneals under stringent hybridisation conditions to any of the nucleic acids of the present invention according to the first, second, or third alternative as disclosed herein. Stringent hybridisation conditions are typically those described herein.

Finally, the nucleic acid molecule according to the present invention can, as a fifth alternative, also be a nucleic acid molecule which, but for the degeneracy of the genetic code, would hybridise to any of the nucleic acid molecules of the present invention according to the first, second, third, and fourth alternative as outlined herein. This kind of nucleic acid molecule refers to the fact that preferably the nucleic acids according to the present invention code for the protein, hyperimmune serum reactive antigens or antigen, or fragments thereof or variants thereof, according to the present invention. This kind of nucleic acid molecule is particularly useful in the detection of a nucleic acid molecule according to the present invention and thus the diagnosis of the respective microorganisms such as *B. burgdorferi* s.s. or any pathogenic *Borrelia* species, particularly those pathogenic *Borrelia* species disclosed herein, and any disease or, diseased condition where these kinds of microorganism are involved, which preferably is that such microorganism is causing directly or indirectly, such as an opportunistic microorganism such disease or diseased condition. Preferably, the hybridisation could occur or be preformed under stringent conditions as described in connection with the fourth alternative described herein.

Nucleic acid molecule as used herein generally refers to any ribonucleic acid molecule or deoxyribonucleic acid molecule, which may be unmodified RNA or DNA or modified RNA or DNA. Thus, for instance, nucleic acid molecule as used herein refers to, among other, single- and double-stranded DNA, DNA that is a mixture of single- and double-stranded RNA, and RNA that is a mixture of single- and double-stranded regions, hybrid molecules comprising DNA and RNA that may be single-stranded or, more typically, double-stranded, or triple-stranded, or a mixture of single- and double-stranded regions. In addition, nucleic acid molecule as used herein refers to triple-stranded regions comprising RNA or DNA or both RNA and DNA. The strands in such regions may be from the same molecule or from different molecules. The regions may include all of one or more of the molecules, but more typically involve only a region of some of the molecules. One of the molecules of a triple-helical region often is an oligonucleotide. As used herein, the term nucleic acid molecule includes DNAs or RNAs as described above that contain one or more modified bases. Thus, DNAs or RNAs with backbones modified for stability or for other reasons are "nucleic acid molecule" as that term is intended herein. Moreover, DNAs or RNAs comprising unusual bases, such as inosine, or modified bases, such as tritylated bases, to name just two examples, are nucleic acid molecule as the term is used herein. It will be appreciated that a great variety of modifications have been made to DNA and RNA that serve many useful purposes known to those of skill in the art. The term nucleic acid molecule as it is employed herein embraces such chemically, enzymatically or metabolically modified forms of nucleic acid molecule, as well as the chemical forms of DNA and RNA characteristic of viruses and cells, including simple and complex cells, inter alia. The term nucleic acid molecule also embraces short nucleic acid molecules often referred to as oligonucleotide(s). "Polynucleotide" and "nucleic acid" or "nucleic acid molecule" are often used interchangeably herein.

Nucleic acid molecules provided in the present invention also encompass numerous unique fragments, both longer and shorter than the nucleic acid molecule sequences set forth in the sequencing listing of the present application, more specifically of the *B. burgdorferi* s.s. coding regions, which can be generated by standard cloning methods. To be unique, a fragment must be of sufficient size to distinguish it from other known nucleic acid sequences, most readily determined by comparing any selected *B. burgdorferi* s.s. fragment to the nucleotide sequences in computer databases such as GenBank. It will be appreciated by the ones skilled in the art that what is said herein in any aspect in relation to *B. burgdorferi* s.l. applies equally to any of the other *Borrelia* species described herein, more preferably any pathogenic *Borrelia* species described herein.

Additionally, modifications can be made to the nucleic acid molecules and polypeptides that are encompassed by the present invention. For example, nucleotide substitutions can be made which do not affect the polypeptide encoded by the nucleic acid, and thus any nucleic acid molecule which encodes a hyperimmune serum reactive antigen or fragments thereof is encompassed by the present invention.

Furthermore, any of the nucleic acid molecules encoding hyperimmune serum reactive antigens or fragments thereof provided by the present invention can be functionally linked, using standard techniques such as standard cloning techniques, to any desired regulatory sequences, whether an *B. burgdorferi* s.l. regulatory sequence or a heterologous regulatory sequence, heterologous leader sequence, heterologous marker sequence or a heterologous coding sequence to create a fusion protein.

Nucleic acid molecules of the present invention may be in the form of RNA, such as mRNA or cRNA, or in the form of DNA, including, for instance, cDNA and genomic DNA obtained by cloning or produced by chemical synthetic techniques or by a combination thereof. The DNA may be triple-stranded, double-stranded or single-stranded. Single-stranded DNA may be the coding strand, also known as the sense strand, or it may be the non-coding strand, also referred to as the anti-sense strand.

The present invention further relates to variants of the nucleic acid molecules described herein which encode fragments, analogs and derivatives of the hyperimmune serum reactive antigens and fragments thereof having a deducted *B. burgdorferi* s.l. amino acid sequence set forth in the Sequence Listing. A variant of the nucleic acid molecule may be a naturally occurring variant such as a naturally occurring allelic variant, or it may be a variant that is not known to occur naturally. Such non-naturally occurring variants of the nucleic acid molecule may be made by mutagenesis techniques, including those applied to nucleic acid molecules, cells or organisms.

Among variants in this regard are variants that differ from the aforementioned nucleic acid molecules by nucleotide substitutions, deletions or additions. The substitutions, deletions or additions may involve one or more nucleotides. The variants may be altered in coding or non-coding regions or both. Alterations in the coding regions may produce conservative or non-conservative amino acid substitutions, deletions or additions. Preferred are nucleic acid molecules encoding a variant, analog, derivative or fragment, or a variant, analogue or derivative of a fragment, which have an *B. burgdorferi* s.l. sequence as set forth in the Sequence Listing, in which several, a few, 5 to 10, 1 to 5, 1 to 3, 2, 1 or no amino acid(s) is substituted, deleted or added, in any combination. Especially preferred among these are silent substitutions, additions and deletions, which do not alter the properties and activities of the *B. burgdorferi* s.l. polypeptides set forth in the Sequence Listing. Also especially preferred in this regard are conservative substitutions.

Variants of any of the antigens in their various embodiments disclosed herein and in particular the antigens and peptides specified herein by Seq ID Nos 135 to 268, 388 to 506 or 629 to 750, can typically also be characterized by means of bioinformatics. Respective tools such as the NCBI Basic Local Alignment Search Tool (BLAST) (Altschul, S. et al., 1990) are available from several sources, including the National Center for Biotechnology Information (NCBI, Bethesda, Md.) and on the Internet, for use in connection with the sequence analysis programs blastp, blastn, blastx, tblastn and tblastx. For comparisons of amino acid sequences of at least 35 amino acids, the Blast 2 sequences function of NCBI Blast 2.0 was employed using the default BLOSUM62 matrix set to default parameters (gapped blastp; gap existence cost of 11, and a per residue gap cost of 1). When aligning short peptides (fewer than around 35 amino acids), the alignment is performed using the Blast 2 sequences function, employing the PAM30 matrix set to default parameters (open gap 9, extension gap 1 penalties). Methods for determining sequence identity over such short windows such as 15 amino acids or less are described at the website that is maintained by the National Center for Biotechnology Information in Bethesda, Md.

The functional active variant of an antigen which is also referred to herein either as the functional variant or the active variant which in turn are used herein in an interchangeable manner, is obtained by sequence alterations in the protein, hyperimmune serum reactive antigen or antigen which are collectively also referred to herein as the polypeptides according to the present invention, including each and any variant, fragment, analogue or derivative thereof, if not explicitly indicated to the contrary, wherein the polypeptide according to the present invention with the sequence alterations retains a function of the unaltered polypeptide according to the present invention, such as it specifically binds a polypeptide specific antibody that binds an unaltered form of the polypeptide according to the present invention. Such sequence alterations can include, but are not limited to, conservative substitutions, deletions, mutations and insertions. Preferably, the active variant exhibits reactivity with human sera of Lyme disease patients, more preferably mediates seroconversion and most preferably shows bactericidal activity. These characteristics of the active variant can be assessed e.g. as detailed in the Examples. In the context of the present invention a variant specifically binds a specific antibody (preferably being polyclonal antibodies raised against recombinant proteins in animals such as mouse, rabbit or monoclonal antibodies generated in mouse), exhibits reactivity with human sera of Lyme disease patients, mediates seroconversion or shows bactericidal activity, if the activity of the variant amounts to at least 10%, preferably at least 25%, more preferably at least 50%, even more preferably at least 70%, still more preferably at least 80%, especially at least 90%, particularly at least 95%, most preferably at least 99% of the activity of the antigen without sequence alterations.

The term "functional active variant" or "active variant" includes naturally-occurring allelic variants, as well as mutants or any other non-naturally occurring variants. As is known in the art, an allelic variant is an alternate form of a (poly)peptide that is characterized as having a substitution, deletion, or addition of one or more amino acids that does essentially not alter the biological function of the polypeptide. By "biological function" is preferably meant a function of the polypeptide in cells or organisms in which it naturally occurs, even if the function is not necessary for the growth or survival of the cells and organisms, respectively. For example, the biological function of a porin is to allow the entry into cell of compounds present in the extracellular medium. The biological function is distinct from the antigenic function. A polypeptide according to the present invention can have more than one biological function.

Within any species of the living world, allelic variation is the rule. For example, any bacterial species, e.g. *Borrelia burgdorferi* s.l., is usually represented by a variety of strains (characterized by clonal reproduction) that differ from each other by minor allelic variations. Indeed, a polypeptide that fulfils the same biological function in different strains can have an amino acid sequence that is not identical in each of the strains. Such an allelic variation is equally reflected at the polynucleotide level.

Allelic variation is very common within the *Borrelia* species as described for ospC (Livey, I. et al., 1995).

In a preferred embodiment, the active variant of or the active fragment derived from the polypeptide according to the present invention by amino acid exchanges, deletions or insertions may also conserve, or more preferably improve, the activity (reactivity, seroconversion and/or bactericidal activity as defined herein). Furthermore, these polypeptides may also cover epitopes, which trigger the same or preferably an improved T cell response. These epitopes are referred to as "heteroclitic" as further defined herein. They have a similar or preferably greater affinity to MHC/HLA molecules, and the ability to stimulate the T cell receptors (TCR) directed to the original epitope in a similar or preferably stronger manner. Heteroclitic epitopes can be obtained by rational design i.e. taking into account the contribution of individual residues to binding to MHC/HLA as for instance described by Rammensee et al. (Rammensee, H. et al., 1999, Immunogenetics. 50: 213-219), combined with a systematic exchange of residues potentially interacting with the TCR and testing the resulting sequences with T cells directed against the original epitope. Such a design is possible for a skilled man in the art without undue experimentation.

In a still more preferred embodiment of the invention the active variant of a polypeptide according to the present invention is any of any the polypeptides disclosed herein and more specifically any of the polypeptides defined by the Seq ID Nos 135 to 268, 388 to 506 or 629 to 750, having at least 50% sequence identity to the polypeptides of any of said Seq ID Nos, especially at least 60%, preferably at least 70%, more preferably at least 80%, still more preferably at least 90%, even more preferably at least 95%, most preferably 99% sequence identity to the polypeptides of any of said Seq ID Nos and/or is derived from said polypeptides of any of the sequences of Seq ID Nos by conservative substitutions. Conservative substitutions are those that take place within a family of amino acids that are related in their side chains and chemical properties. Examples of such families are amino acids with basic side chains, with acidic side chains, with non-polar aliphatic side chains, with non-polar aromatic side chains, with uncharged polar side chains, with small side chains, with large side chains etc. In one embodiment, one conservative substitution is included in the peptide. In another embodiment, two conservative substitutions or less are included in the peptide. In a further embodiment, three conservative substitutions or less are included in the peptide.

Examples of conservative amino acid substitutions include, but are not limited to, those listed below:

| Original Residue | Conservative Substitutions |
|---|---|
| Ala | Ser |
| Arg | Lys |
| Asn | Gln; His |
| Asp | Glu |
| Cys | Ser |
| Gln | Asn |
| Glu | Asp |
| His | Asn; Gln |
| Ile | Leu, Val |
| Leu | Ile; Val |
| Lys | Arg; Gln; Asn |
| Met | Leu; Ile |

| Original Residue | Conservative Substitutions |
| --- | --- |
| Phe | Met; Leu; Tyr |
| Ser | Thr |
| Thr | Ser |
| Trp | Tyr |
| Tyr | Trp; Phe |
| Val | Ile; Leu |

The polypeptides according to the present invention, and fragments and variants thereof, also include or consist of modified epitopes wherein preferably one or two of the amino acids of a given epitope are modified or replaced according to the rules disclosed in, e.g., Tourdot, S. et al., 2000, as well as the nucleic acid sequences encoding such modified epitopes. The epitopes as presented by the polypeptides according to the present invention are also referred to herein as the present epitopes.

It is clear that also epitopes derived from the present epitopes by amino acid exchanges improving, conserving or at least not significantly impeding the T cell activating capability of the epitopes are covered by the epitopes according to the present invention. Therefore the present epitopes also cover epitopes, which do not contain the original sequence as derived from B. burgdorferi s.l., but trigger the same or preferably an improved T cell response. These epitope are referred to as "heteroclitic"; they need to have a similar or preferably greater affinity to MHC/HLA molecules, and the need the ability to stimulate the T cell receptors (TCR) directed to the original epitope in a similar or preferably stronger manner.

Another possibility for identifying epitopes and more specifically heteroclitic epitopes includes the screening of peptide libraries with T cells directed against one or several of the present epitopes. A preferred way is the positional scanning of synthetic peptide libraries. Such approaches have been described in detail for instance by Hemmer, B. et al., 1999 and the references given therein.

As an alternative to epitopes represented by the present derived amino acid sequences or heteroclitic epitopes as disclosed herein, also substances or compounds mimicking these epitopes which are also referred to herein as "peptidemimetica" or "retro-inverse-peptides" can be applied and are thus within the present invention.

Another aspect of the design of improved epitopes is their formulation or modification with substances increasing their capacity to stimulate T cells. These include T helper cell epitopes, lipids or liposomes or preferred modifications as described in WO 01/78767.

Another way to increase the T cell stimulating capacity of epitopes is their formulation with immune stimulating substances for instance cytokines or chemokines like interleukin-2, -7, -12, -18, class I and II interferons (IFN), especially IFN-gamma, GM-CSF, TNF-alpha, flt3-ligand and others.

The nucleic acid molecules of the present invention may also be used as a hybridisation probe for, e.g., RNA, cDNA and genomic DNA to isolate full-length cDNAs and genomic clones encoding polypeptides of the present invention and to isolate cDNA and genomic clones of other genes that have a high sequence similarity to the nucleic acid molecules of the present invention. Such probes generally will comprise at least 15 bases. Preferably, such probes will have at least 20, at least 25 or at least 30 bases, and may have at least 50 bases. Particularly preferred probes will have at least 30 bases, and will have 50 bases or less, such as 30, 35, 40, 45, or 50 bases.

For example, the coding region of a nucleic acid molecule of the present invention may be isolated by screening a relevant library using the known DNA sequence to synthesize an oligonucleotide probe. A labelled oligonucleotide having a sequence complementary to that of a gene of the present invention is then used to screen a library of cDNA, genomic DNA or mRNA to determine to which members of the library the probe hybridizes.

The nucleic acid molecules and polypeptides of the present invention may be employed as reagents and materials for the development or manufacture of medicaments and/or diagnostics for diseases, particularly human disease, as further discussed herein.

The nucleic acid molecules of the present invention that are oligonucleotides can be used in the processes herein as described, but preferably for PCR, to determine whether or not the B. burgdorferi s.l. genes identified herein in whole or in part are present and/or transcribed in infected tissue such as skin, synovia or blood. It is recognized that such sequences will also have utility in diagnosis of the stage of infection and type of infection the pathogen has attained. For this and other purposes arrays which are known as such in the art, comprising at least one of the nucleic acids or polypeptides according to the present invention as described herein, may be used.

The nucleic acid molecules according to the present invention may be used for the detection of nucleic acid molecules and organisms or samples containing these nucleic acids. Preferably such detection is for diagnosis, more preferable for the diagnosis of a disease related or linked to the present or abundance of B. burgdorferi s.s. or any other pathogen species of Borrelia, preferably B. afzelii or B. garinii.

Eukaryotes (herein also "individual(s)"), particularly mammals, and especially humans, infected with B. burgdorferi s.s. or any other pathogen species of Borrelia, preferably B. afzelii or B. garinii can be identified by detecting any of the nucleic acid molecules according to the present invention detected at the DNA level by a variety of techniques. Preferred nucleic acid molecules candidates for distinguishing B. burgdorferi s.s. or said other pathogenic Borrelia. from other organisms can be obtained.

The invention provides a process for diagnosing disease, arising from infection with B. burgdorferi s.s. or any other pathogen species of Borrelia, preferably B. afzelii or B. garinii, comprising determining from a sample isolated or derived from an individual an increased level of expression of a nucleic acid molecule having the sequence of a nucleic acid molecule as disclosed herein and more preferably set forth in the Sequence Listing. Expression of nucleic acid molecules can be measured using any one of the methods well known in the art for the quantification of nucleic acid molecules, such as, for example, PCR, RT-PCR, RNase protection, Northern blotting, other hybridisation methods and the arrays described herein.

Isolated as used herein means separated "by the hand of man" from its natural state; i.e., that, if it occurs in nature, it has been changed or removed from its original environment, or both. For example, a naturally occurring nucleic acid molecule or a polypeptide naturally present in a living organism in its natural state is not "isolated", but the same nucleic acid molecule or polypeptide separated from the coexisting materials of its natural state is "isolated", as the term is employed herein. As part of or following isolation, such nucleic acid molecules can be joined to other nucleic acid molecules, such as DNAs, for mutagenesis, to form fusion proteins, and for propagation or expression in a host, for instance. The isolated nucleic acid molecules, alone or joined to other nucleic acid molecules such as vectors, can be introduced into host cells, in culture or in whole organisms. Introduced into host cells in culture or in whole organisms, such DNAs still would be isolated, as the term is used herein, because they would not be in their naturally occurring form or environment. Similarly, the nucleic acid molecules and polypeptides may occur in a composition, such as a media formulations, solutions for introduction of nucleic acid molecules or polypeptides, for example, into cells, compositions or solutions for chemical or enzymatic reactions, for instance, which are not naturally occurring compositions, and, therein remain isolated nucleic acid molecules or polypeptides within the meaning of that term as it is employed herein.

The nucleic acids according to the present invention may be chemically synthesized. Alternatively, the nucleic acids can be isolated from *B. burgdorferi* s.s. or any other pathogen species of *Borrelia*, preferably *B. afzelii* or *B. garinii* by methods known to the one skilled in the art. The same applies to the polypeptides according to the present invention.

According to another aspect of the present invention, a comprehensive set of novel polypeptides is provided. Such polypeptide, as mentioned previously herein, are proteins, hyperimmune serum reactive antigens and antigens as disclosed herein, and the fragments thereof, preferably the active fragments thereof, and the variants thereof, preferably the active variants thereof. Preferably, the polypeptides according to the present invention are hyperimmune serum reactive antigens and fragments thereof. In a preferred embodiment of the invention, a hyperimmune serum-reactive antigen comprising an amino acid sequence being preferably encoded by any one of the nucleic acids molecules and fragments thereof as described herein, are provided. In another preferred embodiment of the invention a novel set of proteins, hyperimmune serum reactive antigens and antigens, and active fragments as well as active variant thereof is provided which comprise amino acid sequences selected from the group comprising Seq ID Nos 135 to 268, 388 to 506 or 629 to 750.

Especially preferred polypeptides according to the present invention, or fragments thereof, are those which are listed in Tables 8 and 10.

The polypeptides according to the present invention, i.e. the proteins, hyperimmune serum reactive antigens and antigens, as provided by the present invention preferably include any polypeptide or molecule set forth in the Sequence Listing as well as polypeptides which have at least 70% identity to such polypeptide according to the present invention, preferably at least 80% or 85% identity to such polypeptide according to the present invention, and more preferably at least 90% similarity (more preferably at least 90% identity) to such polypeptide according to the present invention and more preferably as set forth in the Sequence Listing and still more preferably at least 95%, 96%, 97%, 98%, 99% or 99.5% similarity (still more preferably at least 95%, 96%, 97%, 98%, 99%, or 99.5% identity) to such polypeptide according to the present invention and also include portions of such polypeptides with such portion of the polypeptide generally containing at least 4 amino acids and more preferably at least 8, still more preferably at least 30, still more preferably at least 50 amino acids, such as 4, 8, 10, 20, 30, 35, 40, 45 or 50 amino acids. In a preferred embodiment such portions are active fragments of the polypeptides according to the present invention.

The invention also relates to fragments, analogs, and derivatives of the polypeptides according to the present invention, and fragments thereof and variant thereof. The terms "fragment", "derivative" and "analog" when referring to such polypeptide according to the present invention whose amino acid sequence is preferably set forth in the Sequence Listing, preferably means a polypeptide which retains either individually or in any combination essentially the same or a similar biological function or activity, and/or the same or a similar structural attribute as such polypeptide. It will be acknowledged by the ones skilled in the art that the meaning of the term "similar biological function or activity" as used herein preferably depends on the polypeptide under consideration and more specifically its function. More preferably, a similar biological function or activity differs from the function of the non-fragment or the non-derivative in terms of one or several of the chemical, biological or other activity of such polypeptide according to the present invention. More preferably, the biological function or activity is defined by the extent of activity, affinity, antigenicity, preferably expressed as the antigenic index, immunogenicity, stability and/or specificity. In a preferred embodiment the difference is less than 50%, less than 75% or less than 90%. Particularly preferred fragments, analogs and derivatives are those comprising receptors or domains of enzymes that confer a function essential for viability of *B. burgdorferi* s.s. or any other pathogenic *Borrelia* species, or the ability to cause disease in humans. Further preferred fragments, analogs and derivatives of the polypeptides according to the present invention are those that comprise or contain antigenic or immunogenic determinants in an animal, especially in a human. Such fragments are also referred to as antigenic fragments, antigenic derivatives and antigenic analogs, respectively. It is also within an embodiment of the present invention that such similar biological function or activity is a decrease in undesirable activity. Preferably such decrease is at least 10%, preferably at least 20% and more preferably at least 50% of such activity exhibited by the polypeptide according to the present invention. In a particularly preferred embodiment such decreased undesirable activity is enzymatic and toxic function and/or generation of human cross-reactive antibodies. It will also be acknowledged by the ones skilled in the art that the meaning of the term "similar structural attribute" as used herein preferably depends on the polypeptide under consideration and more specifically its function and/or its structure. In a preferred embodiment such structural attributes are alpha-helix and alpha-helix forming regions, beta-sheet and beta-sheet forming regions, turn and turn-forming regions, coil and coil-forming regions, hydrophilic regions, hydrophobic regions, alpha-amphipathic regions, beta-amphipathic regions, flexible regions, surface-forming regions, substrate binding regions, and high antigenic index regions of the polypeptide according to the present invention, and combinations thereof.

In an embodiment the fragment, derivative, variant or analog of a polypeptide according to the present invention is 1) one in which one or more of the amino acid residues are substituted with a conserved or non-conserved amino acid residue (preferably a conserved amino acid residue) and such substituted amino acid residue may or may not be one encoded by the genetic code, or 2) one in which one or more of the amino acid residues includes a substituent group, or 3) one in the polypeptide according to the present invention or a fragment thereof is fused with another compound, such as a compound to increase the half-life of the polypeptide according to the present invention thereof such as, for example, polyethylene glycol, or 4) one in which the additional amino acids are fused to the polypeptide according to the present invention or a fragment thereof, such as a leader or secretory sequence or a sequence which is employed for purification of said polypeptide according to the present invention or fragment thereof or a proprotein sequence. Such fragments, derivatives, variant and analogs are deemed to be within the scope of those skilled in the art from the teachings herein.

The present invention also relates to proteins, hyperimmune serum reactive antigens and antigens of different *B. burgdorferi* s.s. isolates and isolates from other *Borrelia* species, preferably pathogenic *Borrelia* species including *B. afzelii* and *B. garinii* which are preferably homologues. Such homologues may easily be isolated based on the nucleic acid and amino acid sequences disclosed herein. There are multiple serotypes or clinical strains distinguished to date for each of the pathogens and the typing is based on serotype specific antisera or molecular approaches. The presence of any antigen can accordingly be determined for every serotype. In addition, it is possible to determine the variability of a particular antigen in the various *Borrelia burgdorferi* s.l. genospecies and strains as described for ospC (Livey, I. et al., 1995). The contribution of the various serotypes to the different *Borrelia* infections varies in different age groups and especially geographical regions. It is an important aspect that the most valuable protective antigens need to be conserved among various clinical strains.

Additionally, fusion polypeptides comprising such hyperimmune serum reactive antigens, variants, analogs, derivatives and fragments thereof, and variants, analogs and derivatives of the fragments are also encompassed by the present invention. Such fusion polypeptides and proteins, as well as nucleic acid molecules encoding them, can readily be made using standard techniques, including standard recombinant techniques for producing and expression of a recombinant polynucleic acid encoding a fusion protein.

Among preferred variants are those that vary from a reference by conservative amino acid substitutions. Such substitutions are those that substitute a given amino acid in a polypeptide according to the present invention by another amino acid of like characteristics. Typically seen as conservative substitutions are the replacements, one for another, among the aliphatic amino acids Ala, Val, Leu and Ile; interchange of the hydroxyl residues Ser and Thr, exchange of the acidic residues Asp and Glu, substitution between the amide residues Asn and Gln, exchange of the basic residues Lys and Arg and replacements among the aromatic residues Phe and Tyr.

Further particularly preferred in this regard are variants, analogs, derivatives and fragments, and variants, analogs and derivatives of the fragments, having the amino acid sequence of any polypeptide according to the present invention as disclosed herein and preferably set forth in the Sequence Listing, in which several, a few, 5 to 10, 1 to 5, 1 to 3, 2, 1 or no amino acid residues are substituted, deleted or added, in any combination. Especially preferred among these are silent substitutions, additions and deletions, which do not alter the properties and activities of the peptide of the present invention. Also especially preferred in this regard are conservative substitutions. Most highly preferred are peptides having an amino acid sequence set forth in the Sequence Listing without substitutions.

The polypeptides according to the present invention are preferably provided in an isolated form, and preferably are purified to homogeneity.

An antigenic fragment is preferably defined as a fragment, which is for itself antigenic or may be made antigenic when provided as a hapten. Therefore, also antigens or antigenic fragments showing one or, particularly for longer fragments, only a few amino acid exchanges are enabled by the present invention, provided that the antigenicity or antigenic capacities of such fragments with amino acid exchanges are not severely deteriorated on the exchange(s), i.e., suited for eliciting an appropriate immune response in an individual vaccinated with this antigen and identified by individual antibody preparations from individual sera.

Preferred examples of such fragments of the polypeptides according to the present invention are those which may also be taken from Tables 1, 5, 6, 8 and 10 and which are preferably those corresponding to the antigen in accordance with the eighth aspect of the present invention in its diverse embodiments, more preferably having or comprising the core amino acid sequence indicated in connection therewith.

All these fragments individually and each independently form a preferred selected aspect of the present invention.

It will be appreciated that the invention also relates to, among others, nucleic acid molecules encoding the aforementioned fragments, variants, active variants, and active fragments, nucleic acid molecules that hybridise to nucleic acid molecules encoding the fragments, variants, active variants, and active fragments, particularly those that hybridise under stringent conditions, and nucleic acid molecules, such as PCR primers, for amplifying nucleic acid molecules that encode the fragments. In these regards, preferred nucleic acid molecules are those that correspond to the preferred fragments, as discussed above.

The present invention also relates to vectors, which comprise a nucleic acid molecule or nucleic acid molecules of the present invention, host cells which are genetically engineered with vectors of the invention and the production of the polypeptides according to the present invention by recombinant techniques.

A great variety of expression vectors can be used to express the polypeptides according to the present invention. Generally, any vector suitable to maintain, propagate or express nucleic acids to express a polypeptide in a host may be used for expression in this regard. In accordance with this aspect of the invention the vector may be, for example, a plasmid vector, a single or double-stranded phage vector, a single or double-stranded RNA or DNA viral vector. Starting plasmids disclosed herein are either commercially available, publicly available, or can be constructed from available plasmids by routine application of well-known, published procedures. Preferred among vectors, in certain respects, are those for expression of nucleic acid molecules and the polypeptides according to the present invention. Nucleic acid constructs in host cells can be used in a conventional manner to produce the gene product encoded by the recombinant sequence. Alternatively, the polypeptides according to the preset invention can be synthetically produced by conventional peptide synthesizers. Mature proteins can be expressed in mammalian cells, yeast, bacteria, or other cells under the control of appropriate promoters. Cell-free translation systems can also be employed to produce such proteins using RNAs derived from the DNA construct of the present invention.

Host cells can be genetically engineered to incorporate nucleic acid molecules and express nucleic acid molecules of the present invention. Representative examples of appropriate hosts include bacterial cells, such as streptococci, staphylococci, *E. coli, Streptomyces* and *Bacillus subtillis* cells; fungal cells, such as yeast cells and *Aspergillus* cells; insect cells such as *Drosophila* S2 and *Spodoptera* Sf9 cells; animal cells such as CHO, COS, HeLa, C127, 3T3, BHK, 293 and Bowes melanoma cells; and plant cells.

The polypeptides according to the present invention may be expressed in a modified form, such as a fusion protein, and may include not only secretion signals but also additional heterologous functional regions. Thus, for instance, a region of additional amino acids, particularly charged amino acids, may be added to the N- or C-terminus of the polypeptide to improve stability and persistence in the host cell, during purification or during subsequent handling and storage. Also, regions may be added to the polypeptide to facilitate purification. Such regions may be removed prior to final preparation of the polypeptide. The addition of peptide moieties to polypeptides to engender secretion or excretion, to improve stability or to facilitate purification, among others, are familiar and routine techniques in the art. A preferred fusion protein comprises a heterologous region from immunoglobulin that is useful to solubilize or purify polypeptides. For example, EP 0 464 533 (Canadian counterpart 2045869) discloses fusion proteins comprising various portions of constant region of immunoglobin molecules together with another protein or part thereof. In drug discovery, for example, proteins have been fused with antibody Fc portions for the purpose of high-throughput screening assays to identify antagonists. See for example, (Bennett, D. et al., 1995) and (Johanson, K. et al., 1995). Fusions also may include the polypeptides according to the present invention fused or coupled to moieties other than amino acids, including lipids and carbohydrates. Further, antigens of this invention may be employed in combination with other vaccinal agents described by the prior art, as well as with other species of vaccinal agents derived from other microorganisms. Such proteins are useful in the prevention, treatment and diagnosis of diseases caused by a wide spectrum of *Borrelia* isolates. In a further embodiment the peptide of the invention is fused to an epitope tag which provides an epitope to which an anti-tag substance can selectively bind. The epitope tag is generally placed at the amino- or carboxyl-terminus of the peptide but may be incorporated as an internal insertion or substitution as the biological activity permits. The presence of such epitope-tagged forms of a peptide can be detected using a substance such as an antibody against the tagged peptide. Also, provision of the epitope tag enables the peptide to be readily purified by affinity purification using an anti-tag antibody or another type of affinity matrix that binds to the epitope tag. Various tag polypeptides and their respective antibodies are well known in the art. Examples include poly-histidine (poly-his), poly-histidine-glycine (poly-his-gly) tags, the HA tag polypeptide, the c-myc tag, the Strep tag and the FLAG tag.

The polypeptides according to the present invention can be recovered and purified from recombinant cell cultures by well-known methods including ammonium sulfate or ethanol precipitation, acid extraction, anion or cation exchange chromatography, phosphocellulose chromatography, hydrophobic interaction chromatography, hydroxylapatite chromatography and lectin chromatography.

The polypeptides according to the present invention can be produced by chemical synthesis as well as by biotechnological means. The latter comprise the transfection or transformation of a host cell with a vector containing a nucleic acid according to the present invention and the cultivation of the transfected or transformed host cell under conditions, which are known to the ones skilled in the art. The production method may also comprise a purification step in order to purify or isolate the polypeptide to be manufactured. In a preferred embodiment the vector is a vector according to the present invention.

The polypeptide according to the present invention may be used for the detection of the organism or organisms in a sample containing these organisms or proteins, hyperimmune serum reactive antigens or antigens, including fragments thereof. Preferably such detection is for diagnosis, more preferable for the diagnosis of a disease, most preferably for the diagnosis of a disease related or linked to the presence or abundance of Gram-negative bacteria, especially bacteria selected from the group comprising pathogenic *Borrelia* species including but not necessary limited to *B. afzelii, B. burgdorferi* s.s., *B. garinii, B. lusitaniae* and *B. valaisiana*, more preferably selected from the group comprising *Borrelia burgdorferi* s.s., *Borrelia afzelii* and *Borrelia garinii*.

The nucleic acids according to the present invention can also be used for the diagnosis or detection of organisms or organisms in a sample, whereby the organisms are preferably the same ones as disclosed in connection with the use of the polypeptides according to the present invention and the antibody according to the present invention, respectively. Basically, it is within the skills of the person of the art to design and practice such diagnosis and detection assays and methods, respectively, in the light of the present disclosure. More preferably such diagnosis or detection uses primers or probes to specifically interact with the nucleic acid molecules according to the present invention. The length and design of such primers and probes, respectively, varies depending on the particular method or diagnosis practiced. Using, in a preferred embodiment, a primer for, e.g., a PCR based detection or diagnosis system, i.e. method or assay, the length of the primer will range from about 10 nucleotides to about 30 nucleotides and more preferably from about 16 to 25 nucleotides. In case of a probe based detection or diagnosis system the length of the probe is preferably about the same as specified for the primer based system. Additionally, in case of a probe based system, the probe will comprise a moiety which allows its detection, either directly or indirectly. Such moiety for direct detection can be a radioactive label or a fluorescence label as known to the ones skilled in the art. Such moiety for indirect detection can be a biotin or any other moiety which mediates interaction with a further compound which in turn is labelled so as to allow its detection.

The present invention also relates to diagnostic assays such as quantitative and diagnostic assays for detecting levels of the polypeptides according to the present invention and more preferably hyperimmune serum reactive antigens and fragments thereof of the present invention in cells and tissues, including determination of normal and abnormal levels. Thus, for instance, a diagnostic assay in accordance with the invention for detecting over-expression of the polypeptides according to the present invention compared to normal control tissue samples may be used to detect the presence of an infection, for example, and to identify the infecting organism. Assay techniques that can be used to determine levels of such polypeptides in a sample derived from a host are well known to those of skill in the art. Such assay methods include radio immunoassays, competitive-binding assays, Western Blot analysis and ELISA assays. Among these, ELISA and Western Blot analysis frequently are preferred. An ELISA assay initially comprises preparing an antibody specific to one of the polypeptides according to the present invention, preferably a monoclonal antibody. In addition, a reporter antibody generally is prepared which binds to the monoclonal antibody. The reporter antibody is attached to a detectable reagent such as radioactive, fluorescent or enzymatic reagent, such as horseradish peroxidase enzyme. One or several of the polypeptides according to the present invention and more preferably a hyperimmune serum reactive antigen and fragment thereof according to the present invention may be immobilized on ELISA plates for detection of reactive antibodies in sera of patients or subjects to be tested.

A Western blot assay initially separates the polypeptides according to the present invention individually or in combination by SDS-polyacrylamide gelelectrophoresis and which subsequently are transferred and immobilized onto a solid support matrix, such as nitrocellulose, nylon or combinations thereof. Together with a reporter antibody reactive antibodies can be detected. The reporter antibody is attached to a detectable reagent such as radioactive, fluorescent or enzymatic reagent, such as horseradish peroxidase enzyme.

The polypeptides according to the present invention or the nucleic acid molecules according to the present invention or primers or probes directed thereto as described herein, may also be used for the purpose of or in connection with an array. In case of the nucleic acid molecule according to the present invention and the primers and probes directed thereagainst, the length of the probes and the primer, can also preferably be in the range from about 25 to about 75 nucleotides, more preferably from about 35 to about 50 nucleotides. More particularly, at least one of the polypeptides according to the present invention may be immobilized on a support. Said support typically comprises a variety of the polypeptides according to the present invention and/or hyperimmune serum reactive antigens and fragments thereof whereby the variety may be created by using one or several of the hyperimmune serum reactive antigens and fragments thereof according to the present invention and/or hyperimmune serum reactive antigens and fragments thereof being different. The characterizing feature of such array as well as of any array in general is the fact that at a distinct or predefined region or position on said support or a surface thereof, a distinct polypeptide is immobilized. Because of this any activity at a distinct position or region of an array can be correlated with a specific polypeptide. The number of different polypeptides and more preferably different hyperimmune serum reactive antigens and fragments thereof immobilized on a support may range from as little as 10 to several 1,000 different polypeptides and hyperimmune serum reactive antigens and fragments thereof, respectively. The density of said molecules per $cm^2$ is in a preferred embodiment as little as 10 per $cm^2$ to at least 400 different of such polypeptides per $cm^2$ and more particularly at least 1,000 different of such polypeptides and more preferably different hyperimmune serum reactive antigens and fragments thereof per $cm^2$. What is said herein about the immobilization of the polypeptides according to the present invention and their use, is also applicable to the nucleic acid molecules and the primers and probes, respectively, directed thereagainst, as will be acknowledged by the ones skilled in the art.

The manufacture of such arrays is known to the one skilled in the art and, for example, described in U.S. Pat. No. 5,744,309. The array preferably comprises a planar, porous or non-porous solid support having at least a first surface. The polypeptides according to the present invention are immobilized on said surface. Preferred support materials are, among others, glass or cellulose. It is also within the present invention that the array is used for any of the diagnostic applications described herein. Apart from the polypeptides according to the present invention also the nucleic acid molecules according to the present invention may be used for the generation of an array as described above which, in principle, can be used for any of the purposes disclosed for the array containing polypeptides. This applies as well to an array made of antibodies, preferably monoclonal antibodies as, among others, described herein.

In a further aspect the present invention relates to an antibody directed to any of polypeptides according to the present invention, derivatives, fragments, variants, active fragments and active variants thereof according to the present invention. The present invention includes, for example, monoclonal and polyclonal antibodies, chimeric, single chain, and humanized antibodies, as well as Fab fragments, or the product of a Fab expression library. It is within the present invention that the antibody may be chimeric, i.e. that different parts thereof stem from different species or at least the respective sequences are taken from different species.

Such antibodies in general and in particular directed against the hyperimmune serum reactive antigens and fragments thereof corresponding to a sequence of the present invention can be obtained by direct injection of a polypeptide according to the present invention into an animal or by administering said polypeptide to an animal, preferably a non-human. The antibody so obtained will then bind said polypeptide itself. In this manner, even a sequence encoding only a fragment said polypeptide can be used to generate antibodies binding the whole native polypeptides according to the present invention. Such antibodies can then be used to isolate the polypeptide according to the present invention from tissue expressing those hyperimmune serum reactive antigens and fragments thereof. It will be understood by the ones skilled in the art that this procedure is also applicable to the fragments, variants, active fragments and active variants thereof of said polypeptides.

For preparation of monoclonal antibodies, any technique known in the art, which provides antibodies produced by continuous cell line cultures can be used (as described originally in (Kohler, G. et al., 1975).

Techniques described for the production of single chain antibodies (U.S. Pat. No. 4,946,778) can be adapted to produce single chain antibodies to immunogenic hyperimmune serum reactive antigens and fragments thereof in their diverse embodiments according to this invention. Also, transgenic mice, or other organisms such as other mammals, may be used to express humanized antibodies to the polypeptides according to the present invention.

Alternatively, phage display technology or ribosomal display could be utilized to select antibody genes with binding activities towards the polypeptides according to the present invention either from repertoires of PCR amplified v-genes of lymphocytes from humans screened for possessing respective target antigens or from naïve libraries (McCafferty, J. et al., 1990; Marks, J. et al., 1992). The affinity of these antibodies can also be improved by chain shuffling (Clackson, T. et al., 1991).

If two antigen binding domains are present, each domain may be directed against a different epitope—termed 'bispecific' antibodies.

Preferably the antibody or derivative thereof is modified to make it less immunogenic in the individual. For example, if the individual is human the antibody may most preferably be "humanized", wherein the complementarity determining region(s) of the hybridoma-derived antibody has been transplanted into a human monoclonal antibody, for example as described in (Jones, P. et al., 1986) or (Tempest, P. et al., 1991).

The above-described antibodies may be employed to isolate or to identify clones expressing the polypeptides according to the present invention by attachment of the antibody to a solid support for isolation and/or purification by affinity chromatography.

Thus, among others, antibodies against the polypeptides according to the present invention may be employed to inhibit and/or treat infections, particularly bacterial infections and especially infections arising from pathogenic *Borrelia* species, preferably *B. burgdorferi* s.s., *B. afzelii* and *B. garinii*.

The polypeptides according to the present invention and more specifically hyperimmune serum reactive antigens and fragments thereof in their diverse embodiments include antigenically, epitopically or immunologically equivalent derivatives, which form a particular aspect of this invention. The term "antigenically equivalent derivative" as used herein encompasses such polypeptide according to the present invention or its equivalent which will be specifically recognized by certain antibodies which, when raised to said polypeptide, interfere with the interaction between pathogen and mammalian host. The term "immunologically equivalent derivative" as used herein encompasses a peptide or its equivalent which when used in a suitable formulation to raise antibodies in a vertebrate, the antibodies act to interfere with the interaction between pathogen and mammalian host.

The polypeptides according to the present invention and more specifically the hyperimmune serum reactive antigens and fragments thereof in their diverse embodiments, such as an antigenically or immunologically equivalent derivative or a fusion protein thereof can be used as an antigen to immunize a mouse or other animal such as a rat or chicken. The fusion protein may provide stability to the polypeptide according to the present invention. Such polypeptide may be associated, for example by conjugation, with an immunogenic carrier protein, for example bovine serum albumin (BSA) or keyhole limpet haemocyanin (KLH). Alternatively, an antigenic peptide comprising multiple copies of the polypeptide according to the present invention and more preferably a hyperimmune serum reactive antigen and fragments thereof, or an antigenically or immunologically equivalent hyperimmune serum reactive antigen and fragments thereof, may be sufficiently antigenic to improve immunogenicity so as to obviate the use of a carrier.

The use of a nucleic acid molecule according to the present invention in genetic immunization will preferably employ a suitable delivery method such as direct injection of plasmid DNA into muscle, delivery of DNA complexed with specific protein carriers, coprecipitation of DNA with calcium phosphate, encapsulation of DNA in various forms of liposomes, particle bombardment (Tang, D. et al., 1992), (Eisenbraun, M. et al., 1993) and in vivo infection using cloned retroviral vectors (Seeger, C. et al., 1984).

In a further aspect the present invention relates to a peptide binding to any of the polypeptides according to the present invention, and a method for the manufacture of such peptides whereby the method is characterized by the use of said polypeptide and the basic steps are known to the one skilled in the art.

Such peptides may be generated by using methods according to the state of the art such as phage display or ribosome display. In case of phage display, basically a library of peptides is generated, in form of phages, and this kind of library is contacted with the target molecule, in the present case a polypeptide according to the present invention. Those peptides binding to the target molecule are subsequently removed, preferably as a complex with the target molecule, from the respective reaction. It is known to the one skilled in the art that the binding characteristics, at least to a certain extent, depend on the particularly realized experimental set-up such as the salt concentration and the like. After separating those peptides binding to the target molecule with a higher affinity or a bigger force, from the non-binding members of the library, and optionally also after removal of the target molecule from the complex of target molecule and peptide, the respective peptide(s) may subsequently be characterized. Prior to the characterisation optionally an amplification step is realized such as, e.g. by propagating the peptide encoding phages. The characterisation preferably comprises the sequencing of the target binding peptides. Basically, the peptides are not limited in their lengths, however preferably peptides having a length from about 8 to 20 amino acids are preferably obtained in the respective methods. The size of the libraries may be about $10^2$ to $10^{18}$, preferably $10^8$ to $10^{15}$ different peptides, however, is not limited thereto. In a preferred embodiment such peptides are high-affinity binding peptides. In an even more preferred embodiment the peptides are peptide aptamers.

A particular form of target binding peptides as described above, are the so-called "anticalines" which are, among others, described in German patent application DE 197 42 706. In so far, the present invention is also related to peptides specifically binding to the polypeptides according to the present invention and the use thereof for any of the therapeutic and diagnostic applications described herein, preferably for antibodies.

In a further aspect the present invention relates to functional nucleic acids interacting with any of the polypeptides according to the present invention, and a method for the manufacture of such functional nucleic acids whereby the method is characterized by the use of the polypeptides according to the present invention and the basic steps are known to the one skilled in the art. The functional nucleic acids are preferably aptamers and spiegelmers. In so far, the present invention is also related to aptamers and spiegelmers specifically binding to the polypeptides according to the present invention and the use thereof for any of the therapeutic and diagnostic applications described herein, preferably for antibodies.

Aptamers are D-nucleic acids, which are either single stranded or double stranded and which specifically interact with a target molecule. The manufacture or selection of aptamers is, e.g. described in European patent EP 0 533 838. Basically the following steps are realized. First, a mixture of nucleic acids, i.e. potential aptamers, is provided whereby each nucleic acid typically comprises a segment of several, preferably at least eight subsequent randomized nucleotides. This mixture is subsequently contacted with the target molecule whereby the nucleic acid(s) bind to the target molecule, such as based on an increased affinity towards the target or with a bigger force thereto, compared to the candidate mixture. The binding nucleic acid(s) are/is subsequently separated from the remainder of the mixture. Optionally, the thus obtained nucleic acid(s) is amplified using, e.g. polymerase chain reaction. These steps may be repeated several times giving at the end a mixture having an increased ratio of nucleic acids specifically binding to the target from which the final binding nucleic acid is then optionally selected. These specifically binding nucleic acid(s) are referred to as aptamers. It is obvious that at any stage of the method for the generation or identification of the aptamers samples of the mixture of individual nucleic acids may be taken to determine the sequence thereof using standard techniques. It is within the present invention that the aptamers may be stabilized such as, e.g., by introducing defined chemical groups which are known to the one skilled in the art of generating aptamers. Such modification may for example reside in the introduction of an amino group at the 2'-position of the sugar moiety of the nucleotides. Aptamers are currently used as therapeutic agents. However, it is also within the present invention that the thus selected or generated aptamers may be used for target validation and/or as lead substance for the development of medicaments, preferably of medicaments based on small molecules. This is actually done by a competition assay whereby the specific interaction between the target molecule and the aptamer is inhibited by a candidate drug whereby upon replacement of the aptamer from the complex of target and aptamer it may be assumed that the respective drug candidate allows a specific inhibition of the interaction between target and aptamer, and if the interaction is specific, said candidate drug will, at least in principle, be suitable to block the target and thus decrease its biological availability or activity in a respective system comprising such target. The thus obtained small molecule may then be subject to further derivatisation and modification to optimise its physical, chemical, biological and/or medical characteristics such as toxicity, specificity, biodegradability and bioavailability.

Spiegelmers and their generation or manufacture is based on a similar principle. The manufacture of spiegelmers is described in international patent application WO 98/08856. Spiegelmers are L-nucleic acids, which means that they are composed of L-nucleotides rather than D-nucleotides as aptamers are. Spiegelmers are characterized by the fact that they have a very high stability in biological systems and, comparable to aptamers, specifically interact with the target molecule against which they are directed. In the process of generating spiegelmers, a heterogeneous population of D-nucleic acids is created and this population is contacted with the optical antipode of the target molecule, in the present case for example with the D-enantiomer of the naturally occurring L-enantiomer of the hyperimmune serum reactive antigens and fragments thereof according to the present invention. Subsequently, those D-nucleic acids are separated which do not interact with the optical antipode of the target molecule. But those D-nucleic acids interacting with the optical antipode of the target molecule are separated, optionally identified and/or sequenced and subsequently the corresponding L-nucleic acids are synthesized based on the nucleic acid sequence information obtained from the D-nucleic acids. These L-nucleic acids, which are identical in terms of sequence with the aforementioned D-nucleic acids interacting with the optical antipode of the target molecule, will specifically interact with the naturally occurring target molecule rather than with the optical antipode thereof. Similar to the method for the generation of aptamers it is also possible to repeat the various steps several times and thus to enrich those nucleic acids specifically interacting with the optical antipode of the target molecule.

In a further aspect the present invention relates to functional nucleic acids interacting with any of the nucleic acid molecules according to the present invention, and a method for the manufacture of such functional nucleic acids whereby the method is characterized by the use of the nucleic acid molecules and their respective sequences according to the present invention and the basic steps are known to the one skilled in the art. The functional nucleic acids are preferably ribozymes, antisense oligonucleotides and siRNA. In so far, the present invention is also related to this kind of functional nucleic acid specifically binding to the polypeptides according to the present invention and the use thereof for any of the therapeutic and diagnostic applications described herein, preferably for antibodies.

Ribozymes are catalytically active nucleic acids, which preferably consist of RNA, which basically comprises two moieties. The first moiety shows a catalytic activity whereas the second moiety is responsible for the specific interaction with the target nucleic acid, in the present case the nucleic acid coding for the polypeptides according to the present invention. Upon interaction between the target nucleic acid and the second moiety of the ribozyme, typically by hybridisation and Watson-Crick base pairing of essentially complementary stretches of bases on the two hybridising strands, the catalytically active moiety may become active which means that it catalyses, either intramolecularly or intermolecularly, the target nucleic acid in case the catalytic activity of the ribozyme is a phosphodiesterase activity. Subsequently, there may be a further degradation of the target nucleic acid, which in the end results in the degradation of the target nucleic acid as well as the protein derived from the said target nucleic acid. Ribozymes, their use and design principles are known to the one skilled in the art, and, for example described in (Doherty, E. et al., 2001) and (Lewin, A. et al., 2001).

The activity and design of antisense oligonucleotides for the manufacture of a medicament and as a diagnostic agent, respectively, is based on a similar mode of action. Basically, antisense oligonucleotides hybridise based on base complementarity, with a target RNA, preferably with a mRNA, thereby activating RNase H. RNase H is activated by both phosphodiester and phosphorothioate-coupled DNA. Phosphodiester-coupled DNA, however, is rapidly degraded by cellular nucleases with the exception of phosphorothioate-coupled DNA. These resistant, non-naturally occurring DNA derivatives do not inhibit RNase H upon hybridisation with RNA. In other words, antisense polynucleotides are only effective as DNA RNA hybrid complexes. Examples for this kind of antisense oligonucleotides are described, among others, in U.S. Pat. No. 5,849,902 and U.S. Pat. No. 5,989,912. In other words, based on the nucleic acid sequence of the target molecule which in the present case are the nucleic acid molecules for the hyperimmune serum reactive antigens and fragments thereof according to the present invention, either from the target protein from which a respective nucleic acid sequence may in principle be deduced, or by knowing the nucleic acid sequence as such, particularly the mRNA, suitable antisense oligonucleotides may be designed base on the principle of base complementarity.

Particularly preferred are antisense-oligonucleotides, which have a short stretch of phosphorothioate DNA (3 to 9 bases). A minimum of 3 DNA bases is required for activation of bacterial RNase H and a minimum of 5 bases is required for mammalian RNase H activation. In these chimeric oligonucleotides there is a central region that forms a substrate for RNase H that is flanked by hybridising "arms" comprised of modified nucleotides that do not form substrates for RNase H. The hybridising arms of the chimeric oligonucleotides may be modified such as by 2'-O-methyl or 2'-fluoro. Alternative approaches used methylphosphonate or phosphoramidate linkages in said arms. Further embodiments of the antisense oligonucleotide useful in the practice of the present invention are P-methoxyoligonucleotides, partial P-methoxyoligodeoxyribonucleotides or P-methoxyoligonucleotides.

Of particular relevance and usefulness for the present invention are those antisense oligonucleotides as more particularly described in the above two mentioned US patents. These oligonucleotides contain no naturally occurring 5'=>3'-linked nucleotides. Rather the oligonucleotides have two types of nucleotides: 2'-deoxyphosphorothioate, which activate RNase H, and 2'-modified nucleotides, which do not. The linkages between the 2'-modified nucleotides can be phosphodiesters, phosphorothioate or P-ethoxyphosphodiester. Activation of RNase H is accomplished by a contiguous RNase H-activating region, which contains between 3 and 5 2'-deoxyphosphorothioate nucleotides to activate bacterial RNase H and between 5 and 10 2'-deoxyphosphorothioate nucleotides to activate eukaryotic and, particularly, mammalian RNase H. Protection from degradation is accomplished by making the 5' and 3' terminal bases highly nuclease resistant and, optionally, by placing a 3' terminal blocking group.

More particularly, the antisense oligonucleotide comprises a 5' terminus and a 3' terminus; and from position 11 to 59 5'=>3'-linked nucleotides independently selected from the group consisting of 2'-modified phosphodiester nucleotides and 2'-modified P-alkyloxyphosphotriester nucleotides; and wherein the 5'-terminal nucleoside is attached to an RNase H-activating region of between three and ten contiguous phosphorothioate-linked deoxyribonucleotides, and wherein the 3'-terminus of said oligonucleotide is selected from the group consisting of an inverted deoxyribonucleotide, a contiguous stretch of one to three phosphorothioate 2'-modified ribonucleotides, a biotin group and a P-alkyloxyphosphotriester nucleotide.

Also an antisense oligonucleotide may be used wherein not the 5' terminal nucleoside is attached to an RNase H-activating region but the 3' terminal nucleoside as specified above. Also, the 5' terminus is selected from the particular group rather than the 3' terminus of said oligonucleotide.

The nucleic acids as well as the polypeptides according to the present invention in their diverse embodiments may be used as or for the manufacture of pharmaceutical compositions, especially vaccines. Preferably such pharmaceutical composition, preferably vaccine is, for the prevention or treatment of diseases caused by, related to or associated with Borrelia species, preferably pathogenic Borrelia genospecies and more preferably B. burgdorferi s.s., B. afzelii and B. garinii. In so far another aspect of the invention relates to a method for inducing an immunological response in an individual, particularly a mammal, which comprises inoculating the individual with the polypeptides according to the present invention in their diverse embodiments, or a fragment or variant thereof, adequate to produce antibodies to protect said individual from infection by the above microorganisms.

Yet another aspect of the invention relates to a method of inducing an immunological response in an individual which comprises, through gene therapy or otherwise, delivering a nucleic acid molecule according to the present invention, preferably functionally encoding hyperimmune serum reactive antigens and fragments thereof in their diverse embodiments, for expressing the polypeptide according to the present invention in vivo in order to induce an immunological response to produce antibodies or a cell mediated T cell response, either cytokine-producing T cells or cytotoxic T cells, to protect said individual from disease, whether that disease is already established within the individual or not. One-way of administering the gene is by accelerating it into the desired cells as a coating on particles or otherwise.

A further aspect of the invention relates to an immunological composition which, when introduced into a host capable of having induced within it an immunological response, induces an immunological response in such host, wherein the composition comprises recombinant DNA which codes for and expresses at least one of the polypeptides according to the present invention in their diverse embodiments. The immunological response may be used therapeutically or prophylactically and may take the form of antibody immunity or cellular immunity such as that arising from CTL or CD4+ T cells.

The polypeptides according to the present invention in their diverse embodiments may be fused with a co-protein which may not by itself produce antibodies, but is capable of stabilizing the first protein and producing a fused protein which will have immunogenic and protective properties. This fused recombinant protein preferably further comprises an antigenic co-protein, such as Glutathione-S-transferase (GST) or beta-galactosidase, relatively large co-proteins which solubilise the protein and facilitate production and purification thereof. Moreover, the co-protein may act as an adjuvant in the sense of providing a generalized stimulation of the immune system. The co-protein may be attached to either the amino or carboxy terminus of the first protein.

Also provided by this invention are methods using the nucleic acid molecule according to the present invention in their diverse embodiments in such genetic immunization experiments in animal models of infection with any of the Borrelia species described herein, most preferably B. burgdorferi s.s., B. afzelii and B. garinii. Such molecules will be particularly useful for identifying protein epitopes able to provoke a prophylactic or therapeutic immune response. This approach can allow for the subsequent preparation of monoclonal antibodies of particular value from the requisite organ of the animal successfully resisting or clearing infection for the development of prophylactic agents or therapeutic treatments of the Borrelia species described herein and most preferably B. burgdorferi s.s., B. afzelii and B. garinii, infection in mammals, particularly humans.

The polypeptides according to the present invention in their diverse embodiments may be used as an antigen for vaccination of a host to produce specific antibodies which protect against invasion of bacteria, for example by blocking adherence of bacteria to damaged tissue. Examples of tissue damage and thus damaged tissue include wounds in skin or connective tissue and mucosal tissues caused e.g. by viral infection (esp. respiratory, such as the flu) mechanical, chemical or thermal damage or by implantation of indwelling devices, or wounds in the mucous membranes, such as the mouth, mammary glands, urethra or vagina.

The present invention also includes a vaccine formulation, which comprises one or several of polypeptides according to the present invention in their diverse embodiments together with a suitable carrier. Since said polypeptides according to the present invention may be broken down in the stomach, they are preferably administered parenterally, including, for example, administration that is subcutaneous, intramuscular, intravenous, intradermal intranasal or transdermal. Formulations suitable for parenteral administration include aqueous and non-aqueous sterile injection solutions which may contain anti-oxidants, buffers, bacteriostats and solutes which render the formulation isotonic with the bodily fluid, preferably the blood, of the individual; and aqueous and non-aqueous sterile suspensions which may include suspending agents or thickening agents. The formulations may be presented in unit-dose or multi-dose containers, for example, sealed ampoules and vials, and may be stored in a freeze-dried condition requiring only the addition of the sterile liquid carrier immediately prior to use. The vaccine formulation may also include adjuvant systems for enhancing the immunogenicity of the formulation, such as oil-in-water systems and other systems known in the art. The dosage will depend on the specific activity of the vaccine and can be readily determined by routine experimentation.

According to another aspect, the present invention relates to a pharmaceutical composition comprising one or several of the polypeptides according to the present invention in their diverse embodiments for the various Borrelia species described herein and most preferably B. burgdorferi s.l., B. afzelii or B. garinii. Such a pharmaceutical composition may comprise one, preferably at least two or more of said polypeptides against said Borrelia species. Optionally, such polypeptides may also be combined with antigens against even further pathogens in a combination pharmaceutical composition. Preferably, said pharmaceutical composition is a vaccine for preventing or treating an infection caused by a Borrelia species, more preferably a pathogenic Borrelia species such as B. burgdorferi s.s., B. afzelii or B. garinii and/or other pathogens against which the antigens have been included in the vaccine.

According to a further aspect, the present invention relates to a pharmaceutical composition comprising a nucleic acid molecule according to the present invention. Such a pharmaceutical composition may comprise one or more nucleic acid molecules according to the present invention encoding a polypeptide according to the present invention. Optionally, such nucleic acid molecules encoding the polypeptides according to the present invention are combined with nucleic acid molecules encoding antigens against other pathogens in a combination pharmaceutical composition. Preferably, said pharmaceutical composition is a vaccine for preventing or treating an infection caused by *Borrelia* species, more preferably pathogenic *Borrelia* species as disclosed herein more preferably comprising *B. burgdorferi* s.s., *B. afzelii* and *B. garinii*, and/or other pathogens against which the antigens have been included in the vaccine.

The pharmaceutical composition may contain any suitable auxiliary substances, such as buffer substances, stabilisers or further active ingredients, especially ingredients known in connection of pharmaceutical composition and/or vaccine production.

A preferable carrier/or excipient for the polypeptides according to the present invention in their diverse embodiments, or a nucleic acid molecule according to the present invention is an immunostimulatory compound for further stimulating the immune response to the polypeptide according to the present invention or a coding nucleic acid molecule thereof. Preferably the immunostimulatory compound in the pharmaceutical preparation according to the present invention is selected from the group of polycationic substances, especially polycationic peptides, immunostimulatory nucleic acids molecules, preferably immunostimulatory deoxynucleotides, alum, Freund's complete adjuvants, Freund's incomplete adjuvants, neuroactive compounds, especially human growth hormone, or combinations thereof.

It is also within the scope of the present invention that the pharmaceutical composition, especially vaccine, comprises apart from one or several of the polypeptides according to the present invention in their diverse embodiments and/or nucleic acid molecules coding thereof which are also in accordance with the present invention, other compounds which are biologically or pharmaceutically active. Preferably, the vaccine composition comprises at least one polycationic peptide. The polycationic compound(s) to be used according to the present invention may be any polycationic compound, which shows the characteristic effects according to the WO 97/30721. Preferred polycationic compounds are selected from basic polypeptides, organic polycations, basic polyamino acids or mixtures thereof. These polyamino acids should have a chain length of at least 4 amino acid residues (WO 97/30721). Especially preferred are substances like polylysine, polyarginine and polypeptides containing more than 20%, especially more than 50% of basic amino acids in a range of more than 8, especially more than 20, amino acid residues or mixtures thereof. Other preferred polycations and their pharmaceutical compositions are described in WO 97/30721 (e.g. polyethyleneimine) and WO 99/38528. Preferably these polypeptides contain between 20 and 500 amino acid residues, especially between 30 and 200 residues.

These polycationic compounds may be produced chemically or recombinantly or may be derived from natural sources.

Cationic (polypeptides may also be anti-microbial with properties as reviewed in (Ganz, T., 1999). These (poly)peptides may be of prokaryotic or animal or plant origin or may be produced chemically or recombinantly (WO 02/13857). Peptides may also belong to the class of defensins (WO 02/13857). Sequences of such peptides can be, for example, found in the Antimicrobial Sequences Database.

Such host defence peptides or defensives are also a preferred form of the polycationic polymer according to the present invention. Generally, a compound allowing as an end product activation (or down-regulation) of the adaptive immune system, preferably mediated by APCs (including dendritic cells) is used as polycationic polymer.

Especially preferred for use as polycationic substances in the present invention are cathelicidin derived antimicrobial peptides or derivatives thereof (International patent application WO 02/13857, incorporated herein by reference), especially antimicrobial peptides derived from mammalian cathelicidin, preferably from human, bovine or mouse.

Polycationic compounds derived from natural sources include HIV-REV or HIV-TAT (derived cationic peptides, antennapedia peptides, chitosan or other derivatives of chitin) or other peptides derived from these peptides or proteins by biochemical or recombinant production. Other preferred polycationic compounds are cathelin or related or derived substances from cathelin. For example, mouse cathelin is a peptide, which has the amino acid sequence $NH_2$-RLAGLL-RKGGEKIGEKLKKIGOKIKNFFQKLVPQPE-COOH (SEQ ID NO:752). Related or derived cathelin substances contain the whole or parts of the cathelin sequence with at least 15-20 amino acid residues: Derivations may include the substitution or modification of the natural amino acids by amino acids, which are not among the 20 standard amino acids. Moreover, further cationic residues may be introduced into such cathelin molecules. These cathelin molecules are preferred to be combined with the antigen. These cathelin molecules surprisingly have turned out to be also effective as an adjuvant for an antigen without the addition of further adjuvants. It is therefore possible to use such cathelin molecules as efficient adjuvants in vaccine formulations with or without further immunoactivating substances.

Another preferred polycationic substance to be used in accordance with the present invention is a synthetic peptide containing at least 2 KLK-motifs separated by a linker of 3 to 7 hydrophobic amino acids (International patent application WO 02/32451, incorporated herein by reference).

The pharmaceutical composition of the present invention may further comprise immunostimulatory nucleic acid(s). Immunostimulatory nucleic acids are e.g. neutral or artificial CpG containing nucleic acids, short stretches of nucleic acids derived from non-vertebrates or in form of short oligonucleotides (ODNs) containing non-methylated cytosine-guanine di-nucleotides (CpG) in a certain base context (e.g. described in WO 96/02555). Alternatively, also nucleic acids based on inosine and cytidine as e.g. described in the WO 01/93903, or deoxynucleic acids containing deoxy-inosine and/or deoxyuridine residues (described in WO 01/93905 and WO 02/095027, incorporated herein by reference) may preferably be used as immunostimulatory nucleic acids in connection with the present invention. Preferably, the mixtures of different immunostimulatory nucleic acids may be used according to the present invention.

It is also within the present invention that any of the aforementioned polycationic compounds is combined with any of the immunostimulatory nucleic acids as aforementioned. Preferably, such combinations are according to the ones as described in WO 01/93905, WO 02/32451, WO 01/54720, WO 01/93903, WO 02/13857 and WO 02/095027 and WO 03/047602, incorporated herein by reference.

In addition or alternatively such vaccine composition may comprise apart from the polypeptides according to the present invention, and the nucleic acid molecules according to the present invention, preferably the coding nucleic acid molecules according to the present invention, a neuroactive compound. Preferably, the neuroactive compound is human growth factor as, e.g. described in WO 01/24822. Also preferably, the neuroactive compound is combined with any of the polycationic compounds and/or immunostimulatory nucleic acids as afore-mentioned.

Also, the pharmaceutical composition in accordance with the present invention is a pharmaceutical composition which comprises at least any of the following compounds or combinations thereof: the nucleic acid molecules according to the present invention, the polypeptides according to the present invention in their diverse embodiments, the vector according to the present invention, the cells according to the present invention, the antibody according to the present invention, the functional nucleic acids according to the present invention and the binding peptides such as the anticalines and high-affinity binding peptides and peptide aptamers, respectively, according to the present invention, any agonists and antagonists according to the present invention, preferably screened as described herein. In connection therewith any of these compounds may be employed in combination with a non-sterile or sterile carrier or carriers for use with cells, tissues or organisms, such as a pharmaceutical carrier suitable for administration to a subject. Such compositions comprise, for instance, a media additive or a therapeutically effective amount of a hyperimmune serum reactive antigen and fragments thereof of the invention and a pharmaceutically acceptable carrier or excipient. Such carriers may include, but are not limited to, saline, buffered saline, dextrose, water, glycerol, ethanol and combinations thereof. The formulation should suit the mode of administration.

The pharmaceutical compositions of the present invention may be administered in any effective, convenient manner including, for instance, administration by topical, oral, anal, vaginal, intravenous, intraperitoneal, intramuscular, subcutaneous, intranasal, intratracheal or intradermal routes among others.

In therapy or as a prophylactic, the active agent of the pharmaceutical composition of the present invention may be administered to an individual as an injectable composition, for example as a sterile aqueous dispersion, preferably isotonic.

Alternatively the composition, preferably the pharmaceutical composition may be formulated for topical application, for example in the form of ointments, creams, lotions, eye ointments, eye drops, ear drops, mouthwash, impregnated dressings and sutures and aerosols, and may contain appropriate conventional additives, including, for example, preservatives, solvents to assist drug penetration, and emollients in ointments and creams. Such topical formulations may also contain compatible conventional carriers, for example cream or ointment bases, and ethanol or oleyl alcohol for lotions. Such carriers may constitute from about 1% to about 98% by weight of the formulation; more usually they will constitute up to about 80% by weight of the formulation.

In addition to the therapy described above, the compositions of this invention may be used generally as a wound treatment agent to prevent adhesion of bacteria to matrix proteins exposed in wound tissue and for prophylactic use in dental treatment as an alternative to, or in conjunction with, antibiotic prophylaxis.

In a preferred embodiment the pharmaceutical composition is a vaccine composition. Preferably, such vaccine composition is conveniently in injectable form. Conventional adjuvants may be employed to enhance the immune response. A suitable unit dose for vaccination with a protein antigen is for adults between 0.02 to 3 µg antigen/per kg of body weight and for children between 0.2 to 10 µg antigen/per kg body weight, and such dose is preferably administered 1-3 times and with an interval of 2 to 24 weeks.

With the indicated dose range, no adverse toxicological effects are expected with the compounds of the invention, which would preclude their administration to suitable individuals.

In a further embodiment the present invention relates to diagnostic and pharmaceutical packs and kits comprising one or more containers filled with one or more of the ingredients of the aforementioned compositions of the invention. The ingredient(s) can be present in a useful amount, dosage, formulation or combination. Associated with such container(s) can be a notice in the form prescribed by a governmental agency regulating the manufacture, use or sale of pharmaceuticals or biological products, reflecting approval by the agency of the manufacture, use or sale of the product for human administration.

In connection with the present invention any disease related use as disclosed herein such as, e.g., use of the pharmaceutical composition or vaccine, is particularly a disease or diseased condition which is caused by, linked or associated with *Borrelia*, more preferably any pathogenic *Borrelia* species and more preferably any *Borrelia* species selected from *B. burgdorferi* s.s., *B. afzelii* or *B. garinii*. In connection therewith it is to be noted that the various *Borrelia* species including *B. burgdorferi* s.l. comprise several genospecies and strains including those disclosed herein. A disease related, caused or associated with the bacterial infection to be prevented and/or treated according to the present invention includes Lyme borreliosis (Lyme disease). Further aspects, symptoms, stages and subgroups of Lyme borreliosis as well as specific groups of patients suffering from such disease as also disclosed herein, including in the introductory part, are incorporated herein by reference. More specifically, Lyme borreliosis generally occurs in stages, with remission and exacerbations with different clinical manifestation at each stage (Steere, 1989). Early infection stage 1 consists of localized infection of the skin, followed within days or weeks by stage 2, disseminated infection, and months to years later by stage 3, persistent infection. However, the infection is variable; some patients have only localized infections of the skin, while others display only later manifestations of the illness, such as arthritis. Different clinical syndromes of Lyme borreliosis are also caused by infection with diverse *B. burgdorferi* s.l. species. *B. burgdorferi* s.s. more often causes joint manifestations (arthritis) and heart problems, *B. afzelii* causes mainly dermal symptoms (EM and ACA), and *B. garinii* is mostly responsible for neuroborreliosis.

Localized infection—The most common symptom of stage 1 of an infection is erythema migrans, which occurs in 70-80% of infected people. This skin lesion is often followed by flu-like symptoms, such as myalgia, arthralgia, headache and fever. These non-specific symptoms occur in 50% of patients with erythema migrans.

Disseminated infection—During stage 2 the bacteria move into the blood stream from the site of infection and to more distant tissues and organs. Neurological, cardiovascular and arthritic symptoms that occur in this stage include meningitis, cranial neuropathy and intermittent inflammatory arthritis.

Persistent infection—Stage 3 of the infection is chronic and occurs from months to years after the tick bite. The most common symptom in North America is rheumatoid arthritis, caused by an infection with *B. burgdorferi* s.s. Persistent infection of the central nervous system with *B. garinii* causes more severe neurological symptoms during stage 3, and a persistent infection of the skin with *B. afzelii* results in acrodermatitis chronica atrophicans.

It is within the present invention that each and any of the symptoms, diseases, disorders or syndromes described herein which are either directly or indirectly linked to or arise from a contact of an organism such as any animal or man with a *Borrelia* species, more preferably a pathogenic *Borrelia* species, and most preferably *Borrelia burgdorferi* s.s., *Borrelia garinii, Borrelia afzelii, Borrelia andersonii, Borrelia bissettii, Borrelia valaisiana, Borrelia lusitaniae, Borrelia spielmani, Borrelia japonica, Borrelia tanukii, Borrelia turdae* and *Borrelia sinica* are separately and independently indications, diseases or disorders in the meaning of the present invention. Accordingly and just by means of illustration, a disease in the sense of the present application is Lyme borreliosis as well as erythema migrans, neuroborreliosis and Lyme arthritis.

It is within the present invention that the disease for which the various compounds described herein can be used are also those diseases where the polypeptide according to the present invention is expressed or any disease where the compounds described herein such as the polypeptides according to the present invention, the vaccine, the antibody, and any aptamer and spiegelmer, respectively, are suitable for the treatment and/or diagnosis thereof. Such potential use can arise from cross-reactivity and homology, respectively. It understood by the ones skilled in the art that any disease described in connection with the pharmaceutical composition according to the present invention can be subject to the use of the medicament described herein, and vice versa.

In a still further embodiment the present invention is related to a screening method using any of the polypeptides according to the present invention or any of the nucleic acids according to the present invention. Screening methods as such are known to the one skilled in the art and can be designed such that an agonist or an antagonist is screened. In connection with such screening method preferably an antagonist is screened which in the present case inhibits or prevents the binding of any hyperimmune serum reactive antigen and fragment thereof according to the present invention to an interaction partner. Such interaction partner can be a naturally occurring interaction partner or a non-naturally occurring interaction partner.

The invention also provides a method for screening compounds to identify those, which enhance (agonist) or block (antagonist) the function of the polypeptides according to the present invention or of the nucleic acid molecules of the present invention, such as its interaction with a binding molecule. The method of screening may involve high-throughput.

For example, to screen for agonists or antagonists, the interaction partner of the nucleic acid molecule and nucleic acid, respectively, according to the present invention, maybe a synthetic reaction mix, a cellular compartment, such as a membrane, cell envelope or cell wall, or a preparation of any thereof, may be prepared from a cell that expresses a molecule that binds to the polypeptides according to the present invention. The preparation is incubated with labelled forms of such polypeptides in the absence or the presence of a candidate molecule, which may be an agonist or antagonist. The ability of the candidate molecule to bind the binding molecule is reflected in decreased binding of the labelled ligand. Molecules which bind gratuitously, i.e., without inducing the functional effects of said polypeptides, are most likely to be good antagonists. Molecules that bind well and elicit functional effects that are the same as or closely related to the polypeptides according to the present invention are good agonists.

The functional effects of potential agonists and antagonists may be measured, for instance, by determining the activity of a reporter system following interaction of the candidate molecule with a cell or appropriate cell preparation, and comparing the effect with that of polypeptides according to the present invention or molecules that elicit the same effects as said polypeptides. Reporter systems that may be useful in this regard include but are not limited to colorimetric labelled substrate converted into product, a reporter gene that is responsive to changes in the functional activity of the polypeptides according to the present invention, and binding assays known in the art.

Another example of an assay for antagonists is a competitive assay that combines the polypeptides according to the present invention and a potential antagonist with membrane-bound binding molecules, recombinant binding molecules, natural substrates or ligands, or substrate or ligand mimetics, under appropriate conditions for a competitive inhibition assay. The polypeptides according to the present invention can be labelled such as by radioactivity or a colorimetric compound, such that the molecule number of polypeptides according to the present invention bound to a binding molecule or converted to product can be determined accurately to assess the effectiveness of the potential antagonist.

Potential antagonists include small organic molecules, peptides, polypeptides and antibodies that bind to polypeptides according to the present invention and thereby inhibit or extinguish its activity. Potential antagonists may also be small organic molecules, a peptide, a polypeptide such as a closely related protein or antibody that binds to the same sites on a binding molecule without inducing functional activity of the polypeptides according to the present invention.

Potential antagonists include a small molecule, which binds to and occupies the binding site of the polypeptides according to the present invention thereby preventing binding to cellular binding molecules, such that normal biological activity is prevented. Examples of small molecules include but are not limited to small organic molecules, peptides or peptide-like molecules.

Other potential antagonists include antisense molecules (see Okano, H. et al., 1991; or OLIGODEOXYNUCLEOTIDES AS ANTISENSE INHIBITORS OF GENE EXPRESSION; CRC Press, Boca Raton, Fla. (1988), for a description of these molecules).

Preferred potential antagonists include derivatives of the hyperimmune serum reactive antigens and fragments thereof of the invention.

As used herein the activity of a polypeptide according to the present invention is its capability to bind to any of its interaction partner or the extent of such capability to bind to its or any interaction partner.

In a particular aspect, the invention provides the use of the polypeptides according to the present invention hyperimmune serum reactive antigens and fragments thereof, nucleic acid molecules or inhibitors of the invention to interfere with the initial physical interaction between a pathogen and mammalian host responsible for sequelae of infection. In particular the molecules of the invention may be used: i) in the prevention of adhesion of the *Borrelia* species as disclosed herein and more preferably the pathogenic species thereof such as *B. burgdorferi* s.s., *B. afzelii* and *B. garinii* to mammalian extracellular matrix proteins; ii) to block bacterial adhesion between mammalian extracellular matrix proteins and bacterial proteins which mediate tissue reaction; iii) or lead to evasion of immune defense; iv) to block the normal progression of pathogenesis in infections initiated other than by the implantation of in-dwelling devices or by other surgical techniques, e.g. through inhibiting nutrient acquisition.

Each of the DNA coding sequences provided herein may be used in the discovery, development and/or manufacture of antibacterial compounds. The encoded protein upon expression can be used as a target for the screening of antibacterial drugs. Additionally, the DNA sequences encoding the amino terminal regions of the encoded protein or Shine-Delgarno or other translation facilitating sequences of the respective mRNA can be used to construct antisense sequences to control the expression of the coding sequence of interest.

The antagonists and agonists may be employed, for instance, to inhibit diseases arising from infection with *Borrelia* species including *B. burgdorferi* s.s., *B. afzelii* and *B. garinii* such as Lyme borreliosis (Lyme disease).

In a still further aspect the present invention is related to an affinity device such affinity device comprises as least a support material and any of the polypeptides according to the present invention, which is attached to the support material. Because of the specificity of said polypeptides for their target cells or target molecules or their interaction partners, said polypeptides allow a selective removal of their interaction partner(s) from any kind of sample applied to the support material provided that the conditions for binding are met. The sample may be a biological or medical sample, including but not limited to, fermentation broth, cell debris, cell preparation, tissue preparation, organ preparation, blood, urine, lymph liquid, liquor and the like.

The polypeptides according to the present invention may be attached to the matrix in a covalent or non-covalent manner. Suitable support material is known to the one skilled in the art and can be selected from the group comprising cellulose, silicon, glass, aluminium, paramagnetic beads, starch and dextrane.

The present invention is further illustrated by the following figures, tables, examples and the sequence listing, from which further features, embodiments and advantages may be taken. It is to be understood that the present examples are given by way of illustration only and not by way of limitation of the disclosure.

In connection with the present invention

FIG. 2 shows the characterization of the libraries.

FIG. 5 shows examples for induction of epitope-specific antibodies in mice by immunization with *E. coli* lysates.

Table 1 shows the summary of all screens performed with genomic *B. afzelii* libraries and human serum.

Table 2 shows all genes identified from *B. afzelii* as antigens with homologous from *B. burgdorferi* s.s. and *B. garinii*.

Table 3 shows the strains used for gene distribution analysis.

Table 4 shows the summary of the gene distribution analysis for a selected number of antigens in various strains of the respective bacterial species.

Table 5 shows the summary of mouse immunogenicity experiments.

Table 6 shows the summary of the peptide ELISA with human sera.

Table 7 FACS analysis with epitope sera generated in mice.

Table 8 Expressed and purified proteins tested in animals.

Table 9 Most probable number of cells (from Norman, R. L. and Kempe, L. L., 1960).

Table 10 Protection in mice.

The figures and tables to which it might be referred to in the specification are described in the following in more details.

Figure 1A:
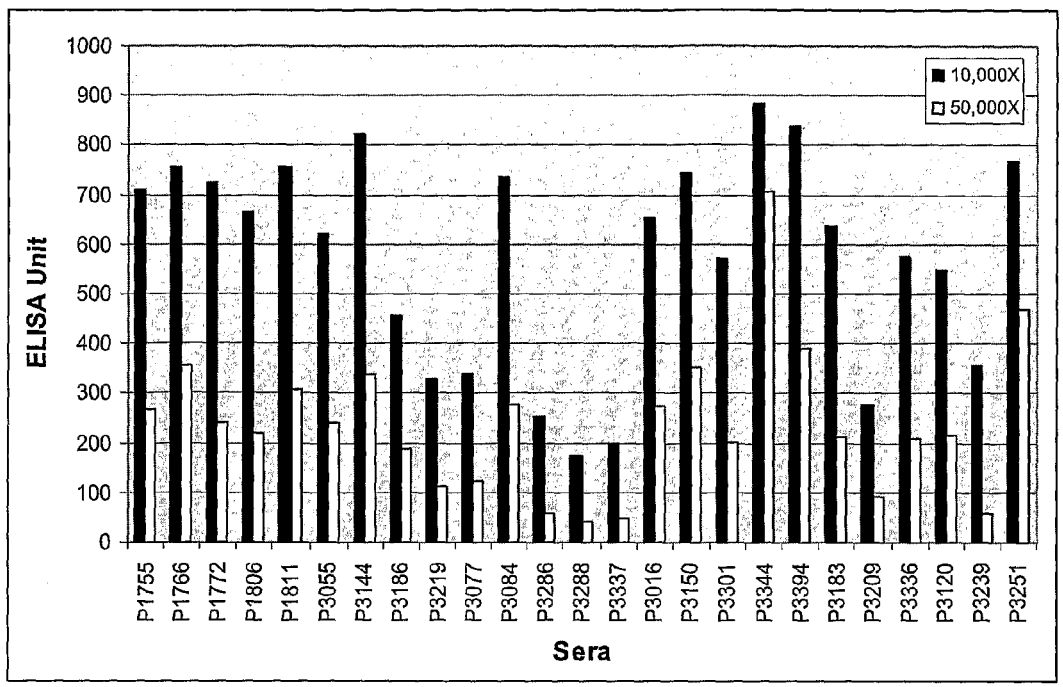
FIG. 1 shows the characterization of human sera as sources of pathogen specific antibodies.
Figure 1B:
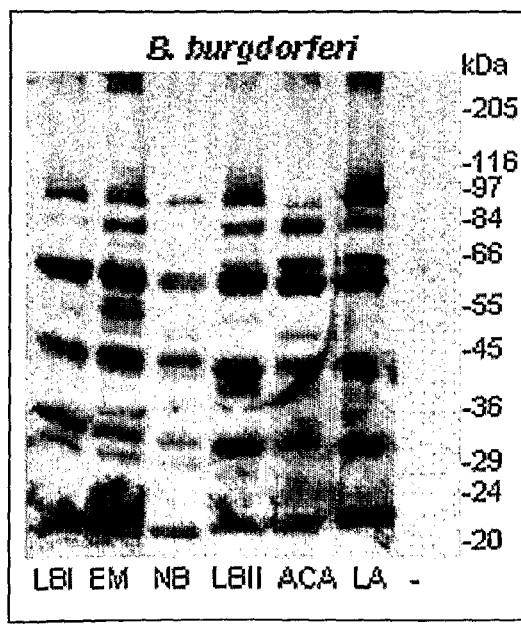
Figure 1C:
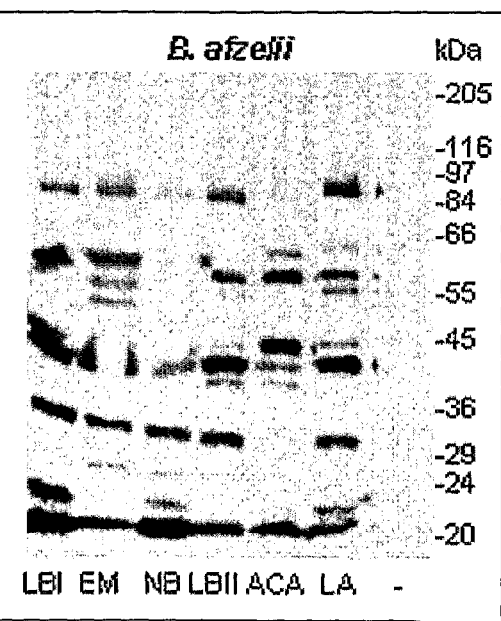

FIG. 1 shows the characterization of human sera by measuring antibodies specific for *B. burgdorferi* s.s. and *B. afzelii* by immune assays. Total IgG antibody levels were measured by standard ELISA (A) using total bacterial lysates prepared from *B. burgdorferi* s.s. Serum samples from Lyme borreliosis patients with different symptoms were analysed at two different serum dilutions. Results of representative experiments are shown for the 25 sera included in the four different serum pools with sera from people with different symptoms of Lyme borreliosis (Erythema migrans (EM), Neuroborreliosis (NB), Lyme arthritis (LA) and acrodermitis chronica atrophicans (ACA)) and two pools with sera from patients with mixed symptoms (LBI and LBII). Data are expressed as ELISA units calculated from absorbance at 405 nm at a serum dilution in the linear range of detection. (B, C) Immunoblot analysis was performed on serum pools in order to ensure multiple immune reactivities with protein antigens. Results of a representative experiment using total bacterial lysate prepared from *B. burgdorferi* s.s. (B) or from *B. afzelii* (C) reacted with human sera at 5,000-fold dilution are shown. IgG antibodies were detected by anti-human IgG specific secondary reagents. —: incubation without primary antibody (serum pool), kDa: molecular weight marker.

FIG. 2 (A) shows the fragment size distribution of the *B. afzelii* small fragment genomic library, K78-LamB. After sequencing randomly selected clones, sequences were trimmed (428) to eliminate vector residues and the numbers of clones with various genomic fragment sizes were plotted. (B) shows the fragment size distribution of the *B. afzelii* large fragment genomic library, K78-FhuA. After sequencing randomly selected clones, sequences were trimmed (466) to eliminate vector residues and the numbers of clones with various genomic fragment sizes were plotted.

FIG. 3 (A) shows the MACS selection with the biotinylated human IgG pool with sera from patients with Erythema migrans (EM-IgG). The K78-FhuA library in pHIE11 was screened with 10-20 µg biotinylated IgG. As negative control, no serum was added to the library cells for screening. Number of cells selected after elution are shown. (B) shows the reactivity of specific clones (1-20) selected by bacterial surface display and Wt (pHIE11 without insert) as analysed by immunoblot analysis with the human serum IgG pool (EM-IgG) used for selection by MACS at a dilution of 1:3,000. Arrows indicate the clones detected as positive. As a loading control the same blot was also analysed with antibodies directed against the platform protein FhuA at a dilution of 1:5,000. (C) shows the MACS selection with the biotinylated human IgG pool with sera from patients with Lyme arthritis (LA-IgG) and the K78-FhuA library in pHIE11. (D) shows the reactivity of specific clones (1-20) selected by bacterial surface display and Wt (pHIE11 without insert) as analysed by immunoblot analysis with the human serum IgG pool (LA-IgG) used for selection by MACS at a dilution of 1:3,000. Arrows indicate the clones detected as positive.

Figure 4:
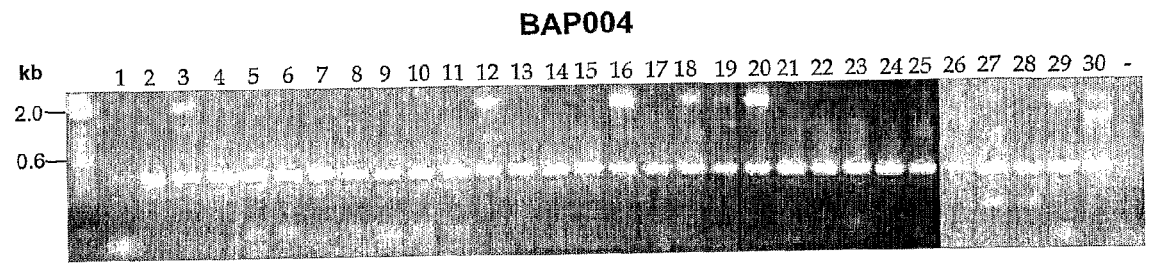
FIG. 4 shows the PCR analysis to determine the gene distribution of selected antigens in clinical isolates of the respective bacterial pathogen.

FIG. 4 shows an example for the PCR analysis for the gene distribution of one gene with the respective oligonucleotides and 30 *B. burgdorferi* s.l. strains. The predicted size of the PCR fragment derived from antigen BAP004 from *B. burgdorferi* s.l. is 420 bp. 1-30, strains or clinical isolates as shown in Table 3; —, no genomic DNA added.

FIG. 5 shows the measurement of epitope-specific mouse serum IgG antibody levels induced by total bacterial lysates of LamB or FhuA expressing *E. coli* clones with *B. afzelii*-derived epitopes. The figure shows a representative peptide ELISA experiment with three sets of mouse sera (pools of 5 mice in each group) generated by epitopes expressed by bacterial clones Baf2 (BA0210), Baf12 (BA0149) and Baf36 (BA0181), respectively. Sera were tested at two different dilutions (200× and 1000×) against overlapping peptides covering the epitopes. Black bars, 200×; white bars, 1000×. Designation of the biotin-labelled synthetic peptides corresponding to the respective epitopes tested are shown below the dilutions.

Figure 6:
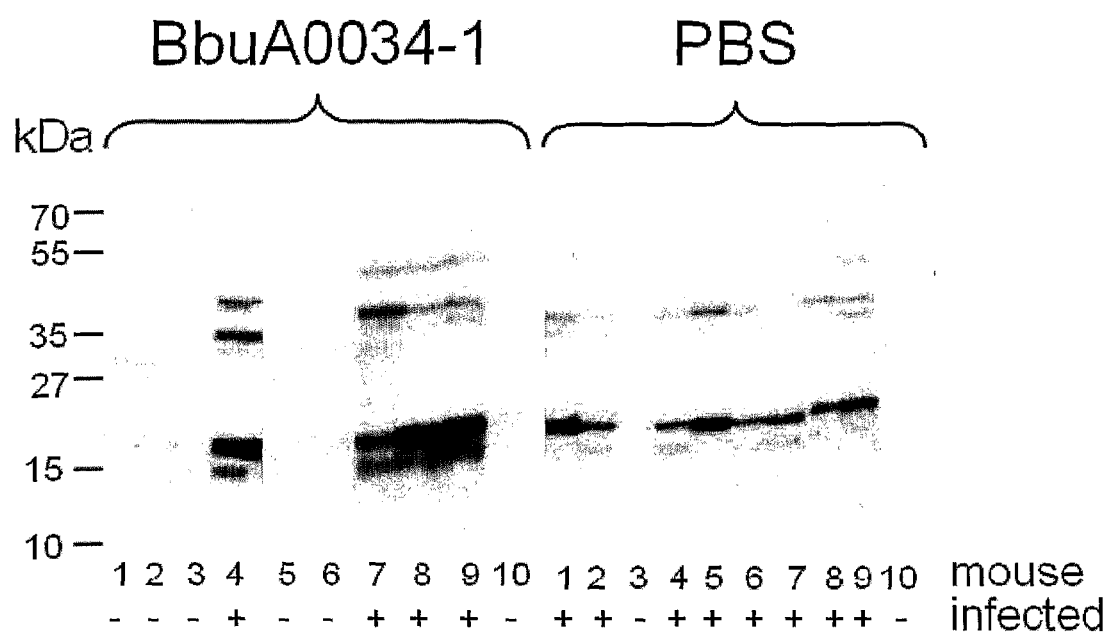
FIG. 6 shows the sero-conversion in mice as determined by Western blot analysis.

FIG. 6 shows the sero-conversion as determined by Western blot analysis. As example for the determination of the infectious status of mice by Western blot analysis, sera from mice immunized with either the *Borrelia* antigen BbuA0034-1 or adjuvant in PBS buffer (PBS) are shown. Nitrocellulose membrane with total *Borrelia* cell lysate was cut into strips which were incubated with the individual mouse sera (1-10) from each group. Sero-conversion (infection) is indicated with a + (plus) and uninfected with a − (minus). kDa: kilo Dalton.

Table 1: Immunogenic Proteins Identified from *B. afzelii* by Bacterial Surface Display.

A: 300 bp library of *B. afzelii* in fhuA with the LBI-IgG pool containing the P1755, P1766, P1772, P1806 and P1811 sera (358), B: 300 bp library of *B. afzelii* in fhuA with the EM-IgG pool containing the P3055, P3144, P3186 and P3219 sera (336), C: 300 bp library of *B. afzelii* in fhuA with the NB-IgG pool containing the P3077, P3084, P3286, P3288 and P3337 sera (597), D: 300 bp library of *B. afzelii* in fhuA with the LBII-IgG pool containing the P3016, P3150, P3301, P3344 and P3394 sera (634), E: 300 bp library of *B. afzelii* in fhuA with the ACA-IgG pool containing P3183, P3209 and P3336 sera (665), F: 300 bp library of *B. afzelii* in fhuA with the LA-IgG pool containing P3120, P3239 and P3251 sera (616), G: 50 bp library of *B. afzelii* in lamB with the LBI-IgG pool (412), H: 50 bp library of *B. afzelii* in lamB with the EM-IgG pool (300), I: 50 bp library of *B. afzelii* in lamB with the NB-IgG pool (467), J: 50 bp library of *B. afzelii* in lamB with the LBII-IgG pool (435), K: 50 bp library of *B. afzelii* in lamB with the ACA-IgG pool (357), L: 50 bp library of *B. afzelii* in lamB with the LA-IgG pool (349); *, prediction of antigenic sequences longer than 5 amino acids was performed with the program ANTIGENIC (Kolaskar, A. et al., 1990). Listed are the genes from *B. afzelii* as identified by BLAST of the determined epitope sequence against the genomic sequence of *B. afzelii, B. burgdorferi* s.s. and *B. garinii*.

TABLE 1

| *B. afzelii* antigenic protein | Putative function (by homology) | Predicted immunogenic aa* | No. of selected clones | Ident. in Screen | Location of identified immunogenic region (aa) | Seq ID (DNA, Prot.) |
|---|---|---|---|---|---|---|
| BA0056 | hypothetical protein | 6-20, 25-51, 58-83, 94-105, 111-122, 127-135, 141-155, 162-173, 179-186, 188-207, 213-226, 230-248, 253-265, 269-282, 285-291, 367-378, 384-393, 401-425, 453-464, 471-477, 504-514, 519-527, 532-555, 557-572, 584-598, 609-616, 624-630, 638-645, 648-653 | 9 | C, D, E, F | 128-169, 257-336, 339-379 | 1, 135 |
| BA0060 | hypothetical protein | 23-31, 47-53, 57-64, 74-89, 91-106, 127-132, 137-144, 152-157, 164-169, 186-192, 201-206, 208-217, 223-235 | 9 | I | 180-189 | 2, 136 |
| BA0062 | methionyl-tRNA formyltransferase (fmt) | 4-32, 43-52, 54-66, 78-88, 91-122, 124-131, 144-150, 153-159, 161-178, 183-191, 195-201, 205-215, 236-252, 258-263, 276-284, 288-294, 302-312 | 2 | A, C, I | 159-213 | 3, 137 |
| BA0072 | peptide chain release factor 2 (prfB) | 8-23, 30-35, 44-54, 65-73, 77-83, 89-110, 117-129, 132-137, 156-165, 169-175, 189-199, 225-237 | 5 | B, C, E, F | 229-267 | 4, 138 |
| BA0075 | predicted coding region | 5-31, 40-50, 52-58, 64-72, 112-118, 137-142, 170-175, 179-185, 192-201, 299-305 | 4 | A, B, E | 138-187 | 5, 139 |
| BA0078 | conserved hypothetical protein | 11-18, 23-47, 113-119, 131-137, 143-149, 197-203, 215-222, 247-256, 264-290, 298-303, 311-358, 368-401, 403-409 | 5 | A, C | 97-177 | 6, 140 |

TABLE 1-continued

| B. afzelii antigenic protein | Putative function (by homology) | Predicted immunogenic aa* | No. of selected clones | Ident. in Screen | Location of identified immunogenic region (aa) | Seq ID (DNA, Prot.) |
|---|---|---|---|---|---|---|
| BA0087 | V-type ATPase, subunit K, putative | 5-20, 27-32, 34-40, 43-64, 66-72, 78-85, 91-97, 104-110, 118-141 | 4 | L | 94-119 | 7, 141 |
| BA0091 | V-type ATPase, subunit A (atpA) | 5-22, 25-32, 39-45, 51-58, 60-104, 106-114, 129-155, 160-166, 174-182, 195-204, 207-213, 223-239, 243-250, 257-267, 270-276, 279-285, 293-302, 304-317, 328-335, 360-372, 374-382, 386-397, 404-418, 429-438, 441-447, 450-460, 467-472, 480-497, 501-507, 515-521, 562-572 | 3 | D | 195-228 | 8, 142 |
| BA0106 | acetyl-CoA C-acetyltransferase (fadA) | 4-10, 31-42, 44-59, 65-72, 75-115, 119-127, 146-155, 181-188, 198-207, 213-219, 228-244, 254-264, 269-293, 295-310, 313-321, 323-336, 350-369, 380-389 | 3 | A, E | 165-214 | 9, 143 |
| BA0126 | ribosomal protein S1 (rpsA) | 11-25, 27-45, 66-73, 75-85, 104-113, 126-135, 143-154, 160-166, 178-185, 201-215, 231-245, 254-261, 266-296, 298-306, 308-332, 339-344, 360-370, 385-391, 412-419, 449-457, 461-469, 472-478, 495-505, 511-518 | 4 | C, E | 350-451 | 10, 144 |
| BA0135 | penicillin-binding protein (pbp-1) | 14-35, 64-72, 81-87, 90-99, 110-116, 137-152, 158-166, 171-178, 207-216, 225-232, 239-250, 264-271, 276-286, 316-323, 325-343, 350-356, 393-407, 416-422, 440-445, 448-453, 469-475, 497-506, 509-529, 537-543, 586-592, 603-610 | 10 | B, C, E | 41-107, 528-596 | 11, 145 |
| BA0149 | flagellar filament 41 kDa core protein (flaB) | 56-62, 83-96, 161-167, 170-179, 184-197, 205-214, 235-243, 285-296, 302-308, 324-333 | 71 | A, B, C, D, B, F, G, H, I, K | 18-315 | 12, 146 |
| BA0150 | flagellar hook-associated protein 2 (fliD) | 4-11, 35-41, 57-65, 82-88, 99-115, 118-124, 126-134, 146-151, 159-167, 174-180, 187-192, 195-206, 216-222, 237-247, 261-269, 295-304, 327-334, 341-347, 363-374, 382-388, 398-404, 410-424, 430-436, 441-448, 451-461, 473-484, 493-507, 509-522, 528-536, 544-550, 566-573, 588-604, 608-614 | 11 | A, C, E | 22-75, 110-148, 344-404 | 13, 147 |

TABLE 1-continued

| B. afzelii antigenic protein | Putative function (by homology) | Predicted immunogenic aa* | No. of selected clones | Ident. in Screen | Location of identified immunogenic region (aa) | Seq ID (DNA, Prot.) |
|---|---|---|---|---|---|---|
| BA0152 | N-acetylglucosamine-6-phosphate deacetylase (nagA) | 4-14, 21-28, 32-38, 59-71, 84-106, 110-120, 127-140, 146-167, 184-190, 197-203, 223-232, 249-278, 280-292, 309-324, 342-355, 367-374, 377-384 | 6 | E | 264-328 | 14, 148 |
| BA0181 | flagellar hook-associated protein (flgK) | 13-18, 47-55, 65-75, 132-138, 140-146, 149-155, 157-168, 218-227, 241-248, 275-281, 283-289, 306-315, 329-336, 352-360, 372-378, 388-394, 396-404, 411-416, 424-429, 445-455, 479-491, 494-500, 571-578, 583-588, 600-621 | 6 | A, B, C, F | 6-65, 68-112, 261-352, 449-507 | 15, 149 |
| BA0192 | hypothetical protein | 10-34, 36-42, 46-55, 58-64, 79-86, 99-122, 125-135, 165-184, 200-209, 215-226, 232-238 | 9 | J | 79-89 | 16, 150 |
| BA0200 | D-alanine--D-alanine ligase (ddlA) | 4-34, 38-62, 64-78, 87-99, 101-109, 113-125, 128-156, 166-184, 186-193, 196-203, 205-215, 220-226, 236-260, 262-269, 271-288, 296-302, 325-333, 339-350 | 3 | K | 111-138 | 17, 151 |
| BA0210 | surface-located membrane protein 1 (lmp1) | 8-23, 25-33, 57-68, 102-113, 194-199, 236-241, 269-296, 326-333, 339-348, 352-360, 364-369, 378-393, 422-430, 434-447, 476-484, 488-501, 530-538, 542-555, 585-592, 596-609, 638-646, 650-663, 692-699, 706-716, 726-745, 765-771, 792-798, 809-815, 825-835, 862-868, 878-885, 893-902, 911-922, 927-937, 947-953, 962-970, 978-985, 1011-1017, 1027-1034, 1045-1052 | 39 | A, B, C, D, E, F | 102-177, 285-364, 937-983 | 18, 152 |
| BA0215 | phosphate ABC transporter, periplasmic phosphate-binding protein (pstS) | 4-20, 36-45, 62-69, 73-83, 95-112, 153-166, 178-185, 194-205, 215-223, 238-247 | 7 | A, C, D, E | 80-159 | 19, 153 |
| BA0221 | flagellar motor switch protein (fliG-1) | 82-95, 107-122, 153-158, 165-171, 178-196, 202-210, 216-222, 270-280, 312-318, 336-341, 381-389 | 11 | A, C, D, E | 245-299 | 20, 154 |
| BA0235 | hypothetical protein | 4-23, 45-57, 68-81, 91-104, 118-131, 134-144, 160-166, 172-189, 191-202, 204-217, 228-236, 261-268, 273-285, 287-294, 307-316, 328-343, 350-356, | 5 | D, E | 126-200 | 21, 155 |

TABLE 1-continued

| B. afzelii antigenic protein | Putative function (by homology) | Predicted immunogenic aa* | No. of selected clones | Ident. in Screen | Location of identified immunogenic region (aa) | Seq ID (DNA, Prot.) |
|---|---|---|---|---|---|---|
| | | 381-418, 420-429, 440-452, 458-465, 497-504, 528-538, 546-556, 567-574, 580-601, 605-624, 628-639, 647-653 | | | | |
| BA0237 | hypothetical protein | 4-19, 24-30, 32-48, 53-80, 89-97, 102-109, 136-142, 145-153, 156-164, 177-187, 192-209, 215-221, 238-243 | 17 | B, D, E, F, K | 15-146 | 22, 156 |
| BA0283 | flagellar hook protein (flgE) | 5-13, 70-79, 91-97, 123-129, 155-162, 173-189, 199-224, 232-238, 255-261, 265-283, 290-301, 306-311, 314-320, 336-344, 351-358, 395-409, 412-418, 430-439 | 6 | B, C, D | 35-109, 187-298 | 23, 157 |
| BA0295 | heat shock protein (hslU) | 13-31, 36-47, 80-96, 98-107, 144-149, 187-193, 215-220, 235-251, 291-300, 306-326, 328-338, 340-358, 364-380, 408-426, 434-441 | 6 | B, C, D | 220-288 | 24, 158 |
| BA0314 | hypothetical protein | 4-24, 36-43, 70-81, 89-100, 109-120, 127-132, 141-158, 165-178, 183-191, 193-202, 208-215 | 4 | C, D | 31-89 | 25, 159 |
| BA0321 | hypothetical protein | 6-25, 44-49, 95-105, 136-144, 199-215, 236-241, 256-262, 280-287, 306-320, 326-334, 346-354, 364-376 | 7 | A, B, D, F | 83-172, 272-327 | 26, 160 |
| BA0327 | oligopeptide ABC transporter, periplasmic oligopeptide-binding protein (oppA-2) | 4-21, 27-44, 85-92, 100-107, 112-118, 142-149, 161-190, 216-222, 231-238, 258-310, 317-323, 334-344, 352-359, 367-373, 380-387, 394-400, 429-441, 485-500 | 40 | A, B, C, D, E, F | 20-79, 404-526 | 27, 161 |
| BA0329 | oligopeptide ABC transporter, periplasmic oligopeptide-binding protein (oppA-3) | 12-28, 38-58, 61-75, 98-116, 121-127, 133-142, 169-199, 213-221, 236-241, 243-250, 254-260, 269-281, 284-301, 313-319, 352-358, 362-368, 391-397, 436-448, 455-463, 485-496, 498-511, 523-533 | 9 | C, D, E | 40-97, 251-297, 420-488 | 28, 162 |
| BA0343 | hypothetical protein | 8-15, 24-41, 50-79, 86-91, 109-141, 143-156, 166-171, 204-212, 235-243, 245-267, 291-311, 328-336, 344-360, 377-388, 390-396 | 3 | D | 258-336 | 29, 163 |

TABLE 1-continued

| B. afzelii antigenic protein | Putative function (by homology) | Predicted immunogenic aa* | No. of selected clones | Ident. in Screen | Location of identified immunogenic region (aa) | Seq ID (DNA, Prot.) |
|---|---|---|---|---|---|---|
| BA0345 | fibronectin/fibrinogen-binding protein, putative | 4-15, 22-38, 46-53, 72-82, 99-119, 131-139, 148-154, 179-184, 187-195, 203-209, 212-219, 223-231, 242-249, 257-263, 269-277, 282-288, 310-315, 346-353, 371-377, 388-395, 400-421, 427-438, 445-451 | 7 | H, I, J | 458-472 | 30, 164 |
| BA0351 | hypothetical protein | 5-29, 37-117, 128-134, 138-144, 146-161, 172-178, 193-219, 221-231, 234-240, 242-261, 263-274, 297-302, 306-322, 339-345, 356-365, 371-383, 402-413, 416-424, 432-443, 447-456, 461-466, 471-524, 532-593 | 7 | A, B, C, D | 197-284 | 31, 165 |
| BA0356 | carboxyl-terminal protease (ctp) | 5-29, 54-69, 72-88, 99-112, 128-138, 150-165, 167-174, 181-187, 205-226, 246-253, 273-279, 285-291, 293-311, 313-323, 329-334, 338-350, 356-363, 366-372, 388-394, 397-404, 417-423, 437-445, 453-473 | 9 | A, B, E, F | 378-461 | 32, 166 |
| BA0364 | aminopeptidase I (yscI) | 38-45, 67-82, 90-96, 101-108, 113-120, 128-143, 160-173, 190-200, 206-218, 226-237, 244-252, 256-271, 276-285, 298-309, 319-325, 332-350, 355-363, 379-388, 395-404, 412-419, 427-433, 442-455 | 7 | A, B, C | 82-127, 212-253 | 33, 167 |
| BA0380 | basic membrane protein B (bmpB) | 10-28, 37-50, 58-66, 72-91, 101-119, 124-131, 133-149, 152-170, 177-186, 198-204, 225-244, 249-256, 260-266, 269-286, 298-303, 306-312, 329-338, 342-348 | 6 | B, D | 26-73 | 34, 168 |
| BA0388 | DNA-directed RNA polymerase (rpoC) | 10-18, 45-51, 58-87, 95-139, 175-182, 184-194, 228-237, 239-245, 255-261, 269-282, 289-295, 301-308, 310-319, 333-374, 376-383, 394-447, 455-464, 485-503, 519-526, 532-542, 551-557, 571-604, 608-614, 616-623, 654-660, 682-687, 717-724, 729-736, 759-775, 800-806, 817-823, 829-838, 840-864, 877-887, 900-906, 943-951, 959-978, 981-994, 996-1012, 1016-1032, 1035-1046, 1049-1056, 1078-1109, | 5 | A, E | 1053-1082 | 35, 169 |

TABLE 1-continued

| B. afzelii antigenic protein | Putative function (by homology) | Predicted immunogenic aa* | No. of selected clones | Ident. in Screen | Location of identified immunogenic region (aa) | Seq ID (DNA, Prot.) |
|---|---|---|---|---|---|---|
| | | 1117-1124, 1137-1143, 1158-1167, 1179-1199, 1201-1207, 1215-1245, 1250-1256, 1262-1268, 1270-1281, 1298-1310, 1314-1323, 1326-1333, 1347-1357, 1364-1372 | | | | |
| BA0389 | DNA-directed RNA polymerase (rpoB) | 4-9, 15-27, 29-37, 50-59, 65-73, 94-107, 138-168, 179-187, 191-203, 230-237, 254-260, 267-274, 279-294, 312-328, 355-361, 368-375, 378-388, 405-415, 441-457, 459-467, 469-476, 496-506, 508-514, 521-531, 538-549, 554-561, 566-574, 582-591, 604-625, 640-653, 657-671, 674-689, 698-705, 713-723, 746-756, 763-771, 777-789, 801-809, 822-839, 847-854, 865-872, 877-883, 889-906, 922-940, 943-953, 963-984, 1004-1010, 1021-1037, 1045-1057, 1070-1089, 1096-1115, 1117-1123, 1127-1135 | 6 | C, D, E | 194-292 | 36, 170 |
| BA0417 | predicted coding region | 10-30, 38-51, 74-81, 86-96, 116-148, 161-167, 202-208, 211-217, 239-261, 283-295, 298-310, 322-328, 335-346 | 5 | B, C, E, F | 44-99 | 37, 171 |
| BA0419 | sensory transduction histidine kinase, putative | 9-23, 31-42, 50-60, 68-74, 85-92, 98-106, 108-117, 135-142, 144-150, 155-172, 174-191, 193-206, 208-215, 223-233, 237-245, 252-267, 274-296, 308-316, 324-341, 375-385, 394-402, 419-440, 446-452, 493-499, 514-520, 537-546, 570-579, 582-588, 591-603, 609-618, 620-628, 640-687, 700-706, 714-742, 765-774, 794-805, 809-825, 827-838, 847-857, 860-867, 875-888, 897-907, 917-926, 937-942, 950-971, 975-981, 989-999, 1016-1052, 1054-1071, 1089-1105, 1108-1130, 1142-1160, 1166-1178, 1184-1197, 1199-1207, 1216-1222, 1232-1247, 1249-1254, 1262-1283, 1291-1300, 1308-1332, 1343-1356, | 7 | B, E, F | 1229-1275 | 38, 172 |

TABLE 1-continued

| B. afzelii antigenic protein | Putative function (by homology) | Predicted immunogenic aa* | No. of selected clones | Ident. in Screen | Location of identified immunogenic region (aa) | Seq ID (DNA, Prot.) |
|---|---|---|---|---|---|---|
| | | 1363-1368, 1384-1398, 1401-1410, 1423-1434, 1443-1464, 1478-1484 | | | | |
| BA0429 | stage 0 sporulation protein J (spo0J) | 5-15, 21-35, 42-51, 55-60, 73-80, 87-94, 103-110, 134-146, 157-168, 174-188, 190-201, 209-223, 250-257 | 9 | C, I, J | 110-131, 179-236 | 39, 173 |
| BA0431 | DNA gyrase, subunit B (gyrB) | 10-24, 30-48, 52-66, 90-100, 111-137, 153-162, 166-175, 184-190, 193-206, 226-232, 238-248, 250-260, 267-273, 322-333, 349-382, 402-413, 421-428, 443-451, 470-480, 487-498, 508-518, 526-539, 544-549, 568-574, 607-623, 631-636 | 3 | B, C | 372-434 | 40, 174 |
| BA0442 | aspartyl-tRNA synthetase (aspS) | 20-28, 33-38, 45-77, 91-110, 124-130, 137-162, 164-170, 175-183, 185-205, 207-217, 235-240, 254-269, 291-296, 319-326, 342-354, 374-381, 397-403, 424-434, 442-455, 469-484, 494-501, 513-522, 529-534, 546-556, 558-564 | 3 | C, E | 439-464 | 41, 175 |
| BA0464 | hypothetical protein | 4-13, 15-21, 24-32, 40-45, 47-65, 75-110, 114-123, 133-142, 144-159, 164-171, 187-215 | 2 | A, E | 12-77 | 42, 176 |
| BA0469 | UDP-N-acetylglucosamine 1-carboxyvinyltransferase (murA) | 4-9, 25-44, 49-60, 72-82, 87-105, 125-138, 142-155, 171-179, 183-197, 205-225, 232-244, 256-270, 278-285, 287-293, 310-333, 339-345, 350-366, 368-378, 381-392, 397-404, 408-418 | 3 | D, E | 281-316 | 43, 177 |
| BA0475 | ribosomal protein L4 (rplD) | 28-35, 95-116, 138-146, 150-158, 174-203 | 3 | D, E | 33-78 | 44, 178 |
| BA0507 | hypothetical protein | 4-23, 31-43, 58-64, 68-83, 93-103, 121-135, 143-156, 181-187, 227-238, 251-264, 292-298, 309-317, 326-333, 351-357, 359-365, 387-395, 400-407, 431-437, 451-460, 462-471, 496-508, 519-526, 534-540, 568-573, 608-618, 620-627, 650-657, 673-679, 690-702, 705-714, 728-734, 738-745, 758-764, 776-782, 795-810, 830-839, 882-904, 911-926, 938-944, 962-969, 975-984, 999-1007, 1019-1025, 1072-1090, | 8 | B, C, E, F | 718-788 | 45, 179 |

TABLE 1-continued

| B. afzelii antigenic protein | Putative function (by homology) | Predicted immunogenic aa* | No. of selected clones | Ident. in Screen | Location of identified immunogenic region (aa) | Seq ID (DNA, Prot.) |
|---|---|---|---|---|---|---|
| | | 1099-1111, 1172-1178, 1232-1241, 1245-1252, 1257-1266, 1283-1288, 1305-1311, 1370-1377, 1392-1398, 1412-1417, 1422-1434, 1448-1458, 1479-1487, 1529-1534, 1570-1576, 1582-1590, 1615-1622, 1630-1645, 1659-1668, 1700-1708, 1730-1736, 1756-1762, 1765-1776, 1798-1803, 1805-1819, 1831-1837, 1872-1882, 1926-1936, 1946-1952, 1955-1961, 1968-1980, 1995-2002, 2035-2045, 2048-2056, 2076-2083, 2099-2107, 2122-2128, 2146-2156 | | | | |
| BA0513 | heat shock protein 70 (dnaK-2) | 12-19, 22-29, 37-43, 48-56, 79-90, 114-119, 136-147, 162-172, 174-180, 186-194, 200-213, 232-238, 275-282, 288-297, 303-319, 329-338, 341-351, 363-371, 383-397, 416-423, 430-438, 454-472, 476-483, 536-542, 576-581, 626-632 | 23 | A, C, D, E, F, J, K | 66-161, 494-576 | 46, 180 |
| BA0514 | GrpE protein (grpE) | 29-35, 48-56, 82-89, 106-112, 118-126, 144-149, 157-173, 175-184 | 8 | D, E | 1-52 | 47, 181 |
| BA0539 | hypothetical protein | 14-36, 48-54, 79-85, 149-159, 171-182, 189-205, 211-217 | 4 | C, F | 171-240 | 48, 182 |
| BA0546 | hypothetical protein | 9-23, 30-40, 56-70, 75-80, 97-103, 111-117, 130-135, 139-145, 149-160, 250-256, 276-286, 309-315, 326-331, 364-376, 385-391, 400-412, 429-434, 446-462, 472-498 | 4 | C, D | 363-430 | 49, 183 |
| BA0553 | heat shock protein 90 (htpG) | 4-28, 44-60, 73-81, 88-94, 102-108, 119-127, 145-170, 201-208, 220-227, 229-239, 291-297, 306-323, 327-335, 342-369, 372-394, 414-420, 427-445, 456-462, 471-478, 494-503, 505-510, 536-542, 549-567, 585-594, 614-627 | 12 | D, E, F | 215-283 | 50, 184 |
| BA0564 | uridylate kinase (smbA) | 4-10, 27-33, 40-48, 64-70, 82-96, 108-115, 123-131, 171-176, 182-204 | 4 | I | 151-160 | 51, 185 |

TABLE 1-continued

| B. afzelii antigenic protein | Putative function (by homology) | Predicted immunogenic aa* | No. of selected clones | Ident. in Screen | Location of identified immunogenic region (aa) | Seq ID (DNA, Prot.) |
|---|---|---|---|---|---|---|
| BA0572 | DNA polymerase III, subunit alpha (dnaE) | 4-15, 19-36, 39-47, 51-57, 62-69, 77-84, 91-97, 103-112, 117-136, 148-168, 189-195, 204-211, 213-228, 234-243, 268-274, 280-289, 294-308, 314-335, 341-349, 354-375, 382-392, 394-405, 419-424, 430-435, 442-469, 479-489, 500-507, 510-516, 523-534, 536-545, 560-579, 586-592, 614-620, 639-649, 652-663, 665-702, 704-710, 727-732, 743-755, 761-781, 799-805, 810-816, 842-851, 885-891, 904-912, 924-931, 933-946, 948-973, 980-988, 990-1007, 1017-1023, 1027-1035, 1046-1055, 1063-1074, 1086-1091, 1095-1102, 1116-1122, 1149-1158 | 5 | B, C, F | 458-497 | 52, 186 |
| BA0581 | pfs protein (pfs-2) | 4-23, 26-32, 50-56, 72-85, 87-104, 106-113, 116-151, 159-174, 176-184, 187-194, 199-206, 211-232, 242-261 | 4 | B, E | 91-170 | 53, 187 |
| BA0596 | membrane-associated protein p66 | 4-24, 53-58, 65-72, 84-96, 106-113, 115-125, 149-154, 176-191, 215-222, 239-244, 267-275, 278-304, 323-340, 345-351, 416-424, 449-455, 473-483, 523-537, 540-556, 564-583, 605-616 | 8 | B, C, D, E, F | 36-119, 343-394 | 54, 188 |
| BA0601 | aminoacyl-histidine dipeptidase (pepD) | 11-27, 45-52, 60-74, 96-102, 123-136, 140-155, 167-189, 194-201, 209-230, 254-261, 264-284, 289-294, 297-305, 319-325, 338-343, 349-361, 363-377, 381-388, 396-409, 413-422, 435-441, 455-469 | 3 | B, C | 342-386 | 55, 189 |
| BA0605 | ATP-dependent Clp protease, subunit X (clpX) | 9-45, 47-54, 72-78, 81-96, 111-118, 123-130, 133-143, 148-154, 157-182, 202-215, 241-255, 290-311, 316-334, 340-346, 349-356, 366-385, 387-400, 403-411 | 8 | D, E | 156-286 | 56, 190 |
| BA0606 | ATP-dependent protease LA (lon-2) | 26-45, 62-70, 84-121, 129-138, 146-168, 182-188, 197-207, 213-220, 222-229, 246-257, 277-283, 304-314, 328-336, 348-371, 375-385, 388-396, 409-421, 429-438, 451-459, | 6 | A, B, C, E | 747-795 | 57, 191 |

TABLE 1-continued

| B. afzelii antigenic protein | Putative function (by homology) | Predicted immunogenic aa* | No. of selected clones | Ident. in Screen | Location of identified immunogenic region (aa) | Seq ID (DNA, Prot.) |
|---|---|---|---|---|---|---|
| | | 465-485, 501-528, 530-536, 555-581, 589-594, 607-614, 620-626, 628-634, 637-643, 650-658, 665-671, 680-691, 703-709, 721-742, 746-758, 761-767, 772-777, 784-790, 796-810 | | | | |
| BA0619 | N-acetylmuramoyl-L-alanine amidase, putative | 4-11, 15-37, 52-66, 79-90, 96-106, 110-118, 124-137, 152-160, 162-171, 174-182, 200-209, 215-222; 227-242, 248-264, 284-308, 325-340, 362-369, 390-418, 420-426, 440-454, 463-471, 478-485, 490-512, 517-532, 539-545, 570-583, 591-605, 621-630, 643-652, 655-665, 684-694 | 9 | A, B, C, D, E, F | 75-223, 285-348 | 58, 192 |
| BA0643 | serine/threonine kinase, putative | 8-18, 25-57, 93-107, 121-128, 135-141, 159-176, 183-191, 202-223, 229-236, 298-304, 332-340, 359-368, 384-393, 410-426, 434-439, 444-449, 476-491, 502-508, 511-523, 525-533, 548-554 | 7 | J | 390-409 | 59, 193 |
| BA0644 | heat shock protein (groEL) | 13-31, 35-41, 50-58, 70-81, 91-100, 120-128, 143-149, 185-191, 196-203, 213-239, 241-251, 256-277, 289-303, 305-316, 364-388, 394-403, 406-412, 417-426, 440-446, 462-469, 494-502, 504-522 | 7 | E | 6-100 | 60, 194 |
| BA0653 | phosphoglycerate mutase (gpmA) | 7-14, 30-36, 43-52, 54-65, 71-85, 95-101, 113-119, 121-127, 153-170, 179-188, 191-200, 204-210, 214-222, 227-233, 244-250 | 6 | A, E, F | 168-223 | 61, 195 |
| BA0663 | flagellar filament outer layer protein (flaA) | 14-21, 25-39, 54-64, 74-99, 102-129, 139-153, 159-166, 188-206, 214-220, 236-243, 245-255, 262-269, 276-295, 300-309, 315-321, 324-331 | 7 | C, D | 12-84 | 62, 196 |
| BA0665 | purine-binding chemotaxis protein (cheW-3) | 4-13, 26-33, 35-49, 55-68, 74-82, 96-114, 116-148, 150-161, 229-235, 237-254, 257-266, 280-286, 305-312, 320-337, 343-356, 373-382, 384-427, 433-439 | 4 | H, I | 50-64 | 63, 197 |

TABLE 1-continued

| B. afzelii antigenic protein | Putative function (by homology) | Predicted immunogenic aa* | No. of selected clones | Ident. in Screen | Location of identified immunogenic region (aa) | Seq ID (DNA, Prot.) |
|---|---|---|---|---|---|---|
| BA0675 | methyl-accepting chemotaxis protein (mcp-4) | 4-46, 53-78, 103-113, 117-122, 144-149, 168-174, 176-183, 193-200, 207-238, 252-259, 271-277, 279-307, 315-326, 330-391, 412-423, 425-464, 472-478, 508-526, 531-542, 551-560, 562-576, 584-593, 602-608, 616-637, 658-666, 714-719, 721-730 | 12 | B, C, D, F, G, H, I, J | 28-73, 292-344, 531-608 | 64, 198 |
| BA0682 | phosphomevalonate kinase, putative | 4-21, 26-33, 69-78, 80-93, 109-125, 127-134, 137-146, 154-160, 162-169, 173-182, 189-199, 210-220, 224-242, 246-278, 284-290, 294-308 | 2 | E | 223-272 | 65, 199 |
| BA0703 | DNA primase (dnaG) | 10-30, 33-42, 46-62, 64-70, 82-97, 112-122, 124-130, 138-145, 148-165, 167-178, 186-192, 196-209, 213-218, 241-249, 258-276, 279-288, 291-299, 302-307, 315-337, 344-349, 360-376, 390-402, 409-415, 417-428, 452-468, 475-484, 486-492 | 2 | B | 180-232 | 66, 200 |
| BA0733 | conserved hypothetical protein | 17-24, 32-43, 49-55, 62-69, 78-92, 97-118, 132-139, 148-154, 173-179, 181-189, 191-210 | 9 | J | 117-131 | 67, 201 |
| BA0737 | antigen, p83/100 | 4-18, 35-44, 54-67, 77-85, 92-101, 106-119, 131-144, 146-164, 171-177, 182-191, 203-218, 282-288, 297-310, 343-359, 361-367, 400-405, 433-439, 454-462, 483-492, 496-504, 506-517, 522-529, 552-559, 564-572, 574-580, 590-604, 625-660 | 54 | A, B, C, D, E, F, G, I, J, K, L | 252-396 | 68, 202 |
| BA0745 | hypothetical protein | 33-50, 67-75, 89-95, 107-116, 119-126, 151-158, 165-170, 175-187, 237-243, 252-258, 272-282, 323-332 | 5 | A, E, K | 115-166 | 69, 203 |
| BA0748 | ABC transporter, ATP-binding protein | 14-23, 41-53, 63-107, 111-134, 136-155, 179-210, 223-233, 261-267, 285-290, 296-302 | 4 | C, F | 203-299 | 70, 204 |
| BA0754 | hypothetical protein | 22-31, 35-41, 53-62, 64-75, 79-90 | 2 | I, K | 1-22 | 71, 205 |
| BA0759 | hypothetical protein | 4-14, 17-30, 33-44, 54-62, 67-76, 78-97, 112-118, 143-152, 163-169, 175-188, 191-199, 207-216, 232-239, 243-249, 262-268, 289-296, 312-319, 335-340 | 12 | B, C, D, E, F, G, L | 1-35, 183-264 | 72, 206 |

TABLE 1-continued

| B. afzelii antigenic protein | Putative function (by homology) | Predicted immunogenic aa* | No. of selected clones | Ident. in Screen | Location of identified immunogenic region (aa) | Seq ID (DNA, Prot.) |
|---|---|---|---|---|---|---|
| BA0767 | flagellar P-ring protein (flgI) | 5-18, 37-53, 56-66, 74-81, 100-110, 120-131, 135-141, 150-156, 174-181, 189-196, 202-211, 225-235, 246-251, 255-260, 311-319, 326-332 | 3 | C, D, E | 245-332 | 73, 207 |
| BA0778 | hypothetical protein | 4-25, 28-34, 41-49, 71-78, 101-120, 125-156, 167-173, 190-199, 207-213, 218-230, 256-267, 269-275, 286-304, 312-320, 341-349, 363-371, 375-384 | 6 | C, D, F | 318-384 | 74, 208 |
| BA0784 | cell division protein (ftsH) | 23-39, 48-58, 60-82, 85-104, 106-112, 117-142, 181-191, 205-213, 219-236, 242-251, 263-276, 295-302, 308-315, 320-330, 335-343, 363-372, 387-392, 413-419, 430-457, 462-470, 477-492, 499-505, 531-540, 542-548, 568-600, 607-614, 620-630 | 4 | B, D, F | 36-419 | 75, 209 |
| BA0790 | hypothetical protein | 9-50, 60-68, 70-78, 84-100, 105-113, 125-133, 141-153, 186-202, 204-209, 212-219, 236-253, 287-301, 310-317, 319-327, 332-342, 353-358, 364-396, 422-430, 437-459, 484-508, 510-520, 535-543, 573-583, 591-598, 610-621, 629-640, 648-653, 675-685, 691-708, 728-735, 738-745, 750-763, 765-773, 790-797, 799-820, 842-854, 857-864, 880-885, 903-909, 923-933, 939-951, 980-986, 991-998, 1019-1024, 1026-1033, 1045-1051, 1064-1075, 1077-1094, 1100-1115, 1139-1157, 1163-1181, 1196-1202, 1207-1213, 1219-1225, 1241-1250, 1275-1290, 1304-1310, 1332-1347, 1352-1365, 1383-1405, 1421-1429, 1433-1442 | 8 | A, B, D, E, F | 1372-1419 | 76, 210 |
| BA0792 | hypothetical protein | 4-40, 60-65, 90-102, 125-138, 150-160, 162-172 | 6 | B, D, E | 14-104 | 77, 211 |
| BA0829 | hypothetical protein | 4-31, 37-53, 59-80, 87-93, 173-183, 185-195, 219-233, 239-247, 265-275 | 3 | B, E | 72-146 | 78, 212 |

TABLE 1-continued

| B. afzelii antigenic protein | Putative function (by homology) | Predicted immunogenic aa* | No. of selected clones | Ident. in Screen | Location of identified immunogenic region (aa) | Seq ID (DNA, Prot.) |
|---|---|---|---|---|---|---|
| BAP001 | hypothetical protein | 5-22, 38-46, 53-58, 69-78, 80-88, 92-99, 117-124, 142-151, 154-165, 189-196, 206-213, 220-226, 288-309 | 313 | A, B, C, D, E, F, G, H, I, J, K, L | 15-106, 137-201 | 79, 213 |
| BAP002 | outer membrane protein | 4-17, 37-47, 58-66, 75-81, 83-89, 106-116, 145-152, 162-168 | 10 | A, D, F | 41-155 | 80, 214 |
| BAP003 | antigen, S2 | 4-16, 50-57, 66-72, 92-100, 102-112, 126-150, 156-167, 194-204, 208-218, 244-256 | 4 | A, B, D | 165-200 | 81, 215 |
| BAP004 | hypothetical protein | 19-26, 38-51, 81-89, 96-103, 107-114, 117-122, 128-134, 150-158, 164-170 | 3 | G | 26-48 | 82, 216 |
| BAP005 | decorin binding protein A (dbpA) | 5-24, 30-35, 42-47, 74-86, 107-117, 146-156 | 16 | A, F | 15-92 | 83, 217 |
| BAP006 | oligopeptide ABC transporter, periplasmic oligopeptide-binding protein (oppAV) | 5-22, 41-49, 55-65, 85-96, 100-106, 111-117, 125-132, 150-155, 161-189, 204-212, 229-243, 262-277, 286-296, 304-311, 314-323, 353-359, 367-373, 391-397, 410-417, 446-451, 485-500 | 10 | A, B, D, E, F | 335-381, 422-484 | 84, 218 |
| BAP007 | lipoprotein | 4-28, 37-43, 65-72, 109-127, 140-148, 155-166, 188-198 | 26 | A, B, C, D, E, F, G, H | 50-215 | 85, 219 |
| BAP008 | hypothetical protein | 4-24, 41-55, 71-79, 84-89, 95-100, 113-125, 138-148, 193-203, 215-221, 300-306, 334-350, 362-369, 385-396 | 36 | A, B, C, D, E, F | 91-213 | 86, 220 |
| BAP009 | antigen, P35, putative | 4-24, 94-101, 103-112, 128-134, 141-148, 156-165, 172-181, 191-197, 281-290 | 6 | B, D, E | 25-76 | 87, 221 |
| BAP010 | outer surface protein, putative | 5-13, 19-25, 27-40, 47-54, 63-69, 84-98, 119-125, 143-158, 170-182, 199-205, 223-234, 237-251, 257-265, 287-292, 296-301, 307-328, 336-352 | 6 | C, D, E, F | 336-362 | 88, 222 |
| BAP011 | oligopeptide ABC transporter, periplasmic oligopeptide-binding protein (oppAIV) | 4-25, 29-36, 41-47, 54-66, 88-95, 97-110, 115-121, 127-135, 164-193, 203-220, 232-244, 269-275, 278-284, 289-316, 320-327, 336-342, 344-353, 355-363, 370-378, 436-442, 449-454, 460-466, 478-489, 492-505 | 6 | C, D, E, F | 311-377 | 89, 223 |
| BAP012 | IMP dehydrogenase (guaB) | 12-34, 40-48, 84-90, 131-138, 140-151, 157-175, 177-187, 193-201, 207-261, 267-281, 306-312, 334-340, 343-349, 352-357, 369-377, 380-394 | 4 | A, C, E, F | 331-386 | 90, 224 |

TABLE 1-continued

| B. afzelii antigenic protein | Putative function (by homology) | Predicted immunogenic aa* | No. of selected clones | Ident. in Screen | Location of identified immunogenic region (aa) | Seq ID (DNA, Prot.) |
|---|---|---|---|---|---|---|
| BAP013 | outer surface protein C (ospC) | 6-20, 54-73, 97-116, 129-135, 138-149, 173-191, 194-208 | 12 | C, D, E, F | 116-212 | 91, 225 |
| BAP014 | hypothetical protein | 11-34, 41-48, 58-72, 82-88, 90-99, 101-109, 137-145, 161-168, 172-188, 193-211, 215-221, 260-269, 271-278, 304-310, 317-327, 336-351 | 4 | K | 208-230 | 92, 226 |
| BAP015 | hypothetical protein | 4-13, 20-30, 73-83, 90-107, 117-137, 226-236, 244-260, 268-275, 286-293, 310-317, 324-330, 340-367, 370-379, 390-422, 427-442, 497-505, 507-513, 549-557, 569-576, 585-593, 611-617, 630-638, 647-657, 659-666, 670-675, 689-699, 726-736, 769-774, 779-802, 866-873, 886-894, 934-940, 956-973, 986-992, 1009-1017, 1026-1041, 1043-1050, 1056-1068 | 61 | A, B, C, D, E, F, G, H, I, J, K, L | 3-48, 576-739 | 93, 227 |
| BAP016 | hypothetical protein | 10-19, 32-40, 42-48, 50-58, 75-85, 88-97, 112-139 | 2 | F | 32-72 | 94, 228 |
| BAP017 | hypothetical protein | 4-13, 20-27, 67-80, 92-98, 101-107, 114-123, 153-169, 174-181, 200-206, 213-219, 226-242, 248-254, 256-289, 299-307, 310-316, 320-326, 329-346, 382-392 | 25 | A, C, D, E, G, I, J, K, L | 324-391 | 95, 229 |
| BAP018 | hypothetical protein | 32-38, 40-47, 49-54, 79-89, 95-101, 110-117, 122-129, 132-140, 151-157, 178-197, 200-206, 216-227, 249-257 | 12 | A, C, D, E, F | 104-143, 148-195 | 96, 230 |
| BAP019 | hypothetical protein | 10-16, 35-47, 52-77, 81-89, 104-109, 115-123, 132-149, 151-160, 163-184, 197-213, 215-245, 252-266, 294-304, 310-337, 342-348, 362-372, 393-398, 408-430, 452-466, 468-476, 485-491, 497-506, 514-520, 530-537, 539-557, 592-606, 627-632, 636-653, 674-688, 693-731, 748-753, 760-766, 783-797, 805-814, 819-825, 833-840, 843-851 | 18 | A, B, C, D, E, F, I, K, L | 91-135, 282-299, 445-477 | 97, 231 |
| BAP020 | hypothetical protein | 11-22, 25-31, 55-65, 83-107, 111-129 | 17 | A, C, D, E, F, G, H, I | 130-137 | 98, 232 |
| BAP021 | hypothetical protein | 15-21, 24-43, 60-68, 86-95, 157-185, 188-197 | 18 | C, D, E, F | 3-75 | 99, 233 |

TABLE 1-continued

| B. afzelii antigenic protein | Putative function (by homology) | Predicted immunogenic aa* | No. of selected clones | Ident. in Screen | Location of identified immunogenic region (aa) | Seq ID (DNA, Prot.) |
|---|---|---|---|---|---|---|
| BAP022 | hypothetical protein | 13-19, 35-44, 56-73, 79-92, 116-129, 143-158, 169-178, 198-210, 215-221, 238-243, 247-256, 261-267, 270-294, 310-320, 331-341, 360-366, 377-387, 397-406, 412-421, 423-439, 449-455, 458-465, 473-479, 483-492, 510-525, 561-569, 571-597, 599-619, 635-641, 686-704, 712-721, 738-755, 761-767, 781-794, 806-813, 844-857, 862-873, 875-882, 889-896, 901-915, 921-931, 937-943, 963-975, 991-997, 1001-1009, 1025-1032, 1040-1046, 1051-1056, 1073-1080, 1096-1105, 1112-1154, 1163-1170, 1173-1180, 1186-1197, 1203-1208, 1224-1232, 1237-1249, 1254-1261 | 9 | A, C, D, E, F | 400-429, 521-545 | 100, 234 |
| BAP023 | antigen, P35, putative | 6-30, 81-87, 117-128, 134-142, 147-158, 178-186, 217-227, 246-255 | 5 | D, E, F | 61-122 | 101, 235 |
| BAP024 | immunogenic protein P35 | 4-22, 31-38, 77-83, 130-137, 159-169, 188-194, 208-229, 231-238, 272-283, 286-294, 308-315, 317-336, 338-347 | 147 | A, B, C, D, E, F, G, H, I, J, K, L | 8-232, 265-318 | 102, 236 |
| BAP025 | hypothetical protein | 9-23, 26-34, 36-42, 73-94, 113-142, 186-192, 200-221, 232-238, 246-252, 254-279, 292-307, 311-316 | 14 | A, C, D, E | 20-62, 95-181 | 103, 237 |
| BAP026 | hypothetical protein | 26-37, 58-67, 83-89, 97-109, 114-141 | 3 | A, C, D | 1-76 | 104, 238 |
| BAP027 | hypothetical protein | 13-20, 28-35, 70-78, 95-102, 156-169, 171-180 | 3 | B, C, D, F | 121-178 | 105, 239 |
| BAP028 | hypothetical protein | 7-20, 32-41, 131-147, 156-166, 219-226, 240-251, 259-270, 275-282, 299-305, 309-315, 336-342, 344-350 | 29 | A, B, C, D, F, G | 195-259 | 106, 240 |
| BAP029 | ErpB2 protein | 7-23, 37-44, 48-63, 93-102, 108-120, 138-145, 219-228, 237-246, 251-270, 277-283, 292-300, 317-323, 336-351, 361-367 | 28 | GA, B, C, D, F, H, I, J, K, L | 19-124, 160-232 | 107, 241 |
| BAP030 | hypothetical protein | 28-35, 40-47, 93-100, 102-110, 158-182 | 5 | C, D, F | 4-77 | 108, 242 |
| BAP031 | erp protein | 8-32, 39-44, 104-110, 157-169, 183-196, 212-217 | 56 | A, B, C, E, G, I | 42-199 | 109, 243 |
| BAP032 | lipoprotein | 4-18, 49-56, 72-81, 90-107, 127-133, 146-151 | 5 | A, B, D, E | 48-114 | 110, 244 |

TABLE 1-continued

| B. afzelii antigenic protein | Putative function (by homology) | Predicted immunogenic aa* | No. of selected clones | Ident. in Screen | Location of identified immunogenic region (aa) | Seq ID (DNA, Prot.) |
|---|---|---|---|---|---|---|
| BAP033 | outer membrane protein, putative | 4-22, 24-30, 42-53, 57-62, 66-80, 83-90, 99-104, 112-118, 132-148, 168-175, 179-186 | 8 | A, B, F | 97-173 | 111, 245 |
| BAP034 | hypothetical protein | 7-19, 33-43, 58-77, 85-91 | 9 | A, B, C, D, E, F, G, J | 14-63 | 112, 246 |
| BAP035 | hypothetical protein | 15-21, 24-35, 75-80, 123-128, 133-139, 148-172 | 56 | A, B, C, D, E, F, G, J | 7-136 | 113, 247 |
| BAP036 | hypothetical protein | 29-35, 51-56, 64-74, 82-88, 100-106, 134-153 | 10 | A, C, D, F | 1-44 | 114, 248 |
| BAP037 | hypothetical protein | 32-44, 65-72, 75-103, 136-144, 159-166 | 5 | A, D, E, F | 136-185 | 115, 249 |
| BAP038 | hypothetical protein | 16-28, 40-53, 74-89, 108-114, 130-140, 152-160, 168-177 | 13 | A, D, E, F, I, J, K | 3-151 | 116, 250 |
| BAP039 | hypothetical protein | 5-27, 39-45, 57-65, 72-83, 130-135 | 11 | B, C, D, G, K | 27-91 | 117, 251 |
| BAP040 | hypothetical protein | 16-22, 31-44, 52-67, 79-84, 95-106, 119-127 | 8 | A, E | 22-78 | 118, 252 |
| BAP041 | hypothetical protein | 4-23, 32-39, 45-53, 67-75, 83-89, 97-112, 133-139, 189-194, 200-205, 241-247, 254-259, 275-282, 287-308, 311-316, 329-339, 344-352 | 45 | A, B, C, D, E, F | 157-246 | 119, 253 |
| BAP042 | hypothetical protein | 4-21, 24-30, 52-77, 81-88, 97-102, 110-115, 125-137 | 7 | D, F | 70-113 | 120, 254 |
| BAP043 | hypothetical protein | 4-20, 33-38, 44-56, 73-81, 123-135, 159-166, 169-181, 199-204 | 23 | B, F | 13-91 | 121, 255 |
| BAP044 | hypothetical protein | 12-18, 23-31, 39-52, 54-60, 63-74, 89-97, 99-111 | 7 | A, D, F | 1-66 | 122, 256 |
| BAP045/ BBS42 | associated protein A | 4-19, 55-62, 76-94, 96-104, 109-126, 154-166 | 4 | E | | 123, 257 |
| CRFA006 | | 4-11, 26-39 | 4 | H, K, L | 11-19 | 124, 258 |
| CRFA514 | | 4-21 | 2 | G | 15-24 | 125, 259 |
| CRFA554 | | 12-25 | 24 | H, I | 23-45 | 126, 260 |
| CRFA657 | | 4-23, 33-55, 59-64, 76-93, 107-125, 129-138 | 6 | K | 54-78 | 127, 261 |
| CRFA744 | | 4-27, 56-82 | 3 | K | 21-40 | 128, 262 |
| CRFA762 | | 8-17, 24-36, 47-61, 76-83 | 2 | J | 65-83 | 129, 263 |
| CRFA780 | | 4-22, 37-46, 54-60, 64-70 | 2 | J | 13-25 | 130, 264 |
| CRFBD21 | | 9-17, 23-41, 64-86 | 4 | G | 6-25, 53-66 | 131, 265 |
| CRFBI14 | | 4-23, 29-48 | 3 | I | 18-29 | 132, 266 |
| CRFBO17 | | 9-20, 26-40, 44-51 | 3 | J | 40-60 | 133, 267 |
| CRFP316 | | 4-9, 11-18, 20-31 | 2 | J | 4-21 | 134, 268 |

Table 2: Immunogenic Proteins Identified from *B. afzelii* by Bacterial Surface Display and their Orthologs from *B. burgdorferi* s.s. and *B. garinii*.

Table 2 shows the identified genes from *B. afzelii* with the respective sequence identification numbers. The best matches in a Blast analysis from *B. burgdorferi* s.s. and *B. garinii* are listed together with their respective sequence identification numbers.

TABLE 2

| *B. afzelii* | | | *B. burgdorferi* s.s. | | | *B. garinii* | | |
| --- | --- | --- | --- | --- | --- | --- | --- | --- |
| ORF | Seq ID (DNA) | Seq ID (Protein) | ORF | Seq ID (DNA) | Seq ID (Protein) | ORF | Seq ID (DNA) | Seq ID (Protein) |
| BA0056 | 1 | 135 | BB0058 | 269 | 388 | BG0057 | 507 | 629 |
| BA0060 | 2 | 136 | BB0062 | 270 | 389 | BG0061 | 508 | 630 |
| BA0062 | 3 | 137 | BB0064 | 271 | 390 | BG0063 | 509 | 631 |
| BA0072 | 4 | 138 | BB0074 | 272 | 391 | BG0073 | 510 | 632 |
| BA0075 | 5 | 139 | BB0077 | 273 | 392 | BG0076 | 511 | 633 |
| BA0078 | 6 | 140 | BB0081 | 274 | 393 | BG0079 | 512 | 634 |
| BA0087 | 7 | 141 | BB0090 | 275 | 394 | BG0091 | 513 | 635 |
| BA0091 | 8 | 142 | BB0094 | 276 | 395 | BG0095 | 514 | 636 |
| BA0106 | 9 | 143 | BB0109 | 277 | 396 | BG0110 | 515 | 637 |
| BA0126 | 10 | 144 | BB0127 | 278 | 397 | BG0129 | 516 | 638 |
| BA0135 | 11 | 145 | BB0136 | 279 | 398 | BG0138 | 517 | 639 |
| BA0149 | 12 | 146 | BB0147 | 280 | 399 | BG0147 | 518 | 640 |
| BA0150 | 13 | 147 | BB0149 | 281 | 400 | BG0148 | 519 | 641 |
| BA0152 | 14 | 148 | BB0151 | 282 | 401 | BG0149 | 520 | 642 |
| BA0181 | 15 | 149 | BB0181 | 283 | 402 | BG0180 | 521 | 643 |
| BA0192 | 16 | 150 | BB0193 | 284 | 403 | BG0191 | 522 | 644 |
| BA0200 | 17 | 151 | BB0200 | 285 | 404 | BG0199 | 523 | 645 |
| BA0210 | 18 | 152 | BB0210 | 286 | 405 | BG0212 | 524 | 646 |
| BA0215 | 19 | 153 | BB0215 | 287 | 406 | BG0218 | 525 | 647 |
| BA0221 | 20 | 154 | BB0221 | 288 | 407 | BG0224 | 526 | 648 |
| BA0235 | 21 | 155 | BB0236 | 289 | 408 | BG0239 | 527 | 649 |
| BA0237 | 22 | 156 | BB0238 | 290 | 409 | BG0241 | 528 | 650 |
| BA0283 | 23 | 157 | BB0283 | 291 | 410 | BG0286 | 529 | 651 |
| BA0295 | 24 | 158 | BB0295 | 292 | 411 | BG0298 | 530 | 652 |
| BA0314 | 25 | 159 | BB0315 | 293 | 412 | BG0318 | 531 | 653 |
| BA0321 | 26 | 160 | BB0323 | 294 | 413 | BG0324 | 532 | 654 |
| BA0327 | 27 | 161 | BB0329 | 295 | 414 | BG0330 | 533 | 655 |
| BA0329 | 28 | 162 | BB0330 | 296 | 415 | BG0331 | 534 | 656 |
| BA0343 | 29 | 163 | BB0345 | 297 | 416 | BG0346 | 535 | 657 |
| BA0345 | 30 | 164 | BB0347 | 298 | 417 | BG0348 | 536 | 658 |
| BA0351 | 31 | 165 | BB0353 | 299 | 418 | BG0354 | 537 | 659 |
| BA0356 | 32 | 166 | BB0359 | 300 | 419 | BG0359 | 538 | 660 |
| BA0364 | 33 | 167 | BB0366 | 301 | 420 | BG0365 | 539 | 661 |
| BA0380 | 34 | 168 | BB0382 | 302 | 421 | BG0381 | 540 | 662 |
| BA0388 | 35 | 169 | BB0388 | 303 | 422 | BG0389 | 541 | 663 |
| BA0389 | 36 | 170 | BB0389 | 304 | 423 | BG0390 | 542 | 664 |
| BA0417 | 37 | 171 | BB0418 | 305 | 424 | BG0421 | 543 | 665 |
| BA0419 | 38 | 172 | BB0420 | 306 | 425 | BG0423 | 544 | 666 |
| BA0429 | 39 | 173 | BB0434 | 307 | 426 | BG0441 | 545 | 667 |
| BA0431 | 40 | 174 | BB0436 | 308 | 427 | BG0443 | 546 | 668 |
| BA0442 | 41 | 175 | BB0446 | 309 | 428 | BG0454 | 547 | 669 |
| BA0464 | 42 | 176 | BB0467 | 310 | 429 | BG0480 | 548 | 670 |
| BA0469 | 43 | 177 | BB0472 | 311 | 430 | BG0484 | 549 | 671 |
| BA0475 | 44 | 178 | BB0479 | 312 | 431 | BG0490 | 550 | 672 |
| BA0507 | 45 | 179 | BB0512 | 313 | 432 | BG0523 | 551 | 673 |
| BA0513 | 46 | 180 | BB0518 | 314 | 433 | BG0529 | 552 | 674 |
| BA0514 | 47 | 181 | BB0519 | 315 | 434 | BG0530 | 553 | 675 |
| BA0539 | 48 | 182 | BB0546 | 316 | 435 | BG0556 | 554 | 676 |
| BA0546 | 49 | 183 | BB0553 | 317 | 436 | BG0563 | 555 | 677 |
| BA0553 | 50 | 184 | BB0560 | 318 | 437 | BG0570 | 556 | 678 |
| BA0564 | 51 | 185 | BB0571 | 319 | 438 | BG0582 | 557 | 679 |
| BA0572 | 52 | 186 | BB0579 | 320 | 439 | BG0591 | 558 | 680 |
| BA0581 | 53 | 187 | BB0588 | 321 | 440 | BG0601 | 559 | 681 |
| BA0596 | 54 | 188 | BB0603 | 322 | 441 | BG0616 | 560 | 682 |
| BA0601 | 55 | 189 | BB0608 | 323 | 442 | BG0621 | 561 | 683 |
| BA0605 | 56 | 190 | BB0612 | 324 | 443 | BG0628 | 562 | 684 |
| BA0606 | 57 | 191 | BB0613 | 325 | 444 | BG0629 | 563 | 685 |
| BA0619 | 58 | 192 | BB0625 | 326 | 445 | BG0644 | 564 | 686 |
| BA0643 | 59 | 193 | BB0648 | 327 | 446 | BG0671 | 565 | 687 |
| BA0644 | 60 | 194 | BB0649 | 328 | 447 | BG0672 | 566 | 688 |
| BA0653 | 61 | 195 | BB0658 | 329 | 448 | BG0681 | 567 | 689 |
| BA0663 | 62 | 196 | BB0668 | 330 | 449 | BG0691 | 568 | 690 |
| BA0665 | 63 | 197 | BB0670 | 331 | 450 | BG0693 | 569 | 691 |
| BA0675 | 64 | 198 | BB0680 | 332 | 451 | BG0703 | 570 | 692 |

TABLE 2-continued

| | B. afzelii | | | B. burgdorferi s.s. | | | B. garinii | |
|---|---|---|---|---|---|---|---|---|
| ORF | Seq ID (DNA) | Seq ID (Protein) | ORF | Seq ID (DNA) | Seq ID (Protein) | ORF | Seq ID (DNA) | Seq ID (Protein) |
| BA0682 | 65 | 199 | BB0687 | 333 | 452 | BG0710 | 571 | 693 |
| BA0703 | 66 | 200 | BB0710 | 334 | 453 | BG0733 | 572 | 694 |
| BA0733 | 67 | 201 | BB0740 | 335 | 454 | BG0761 | 573 | 695 |
| BA0737 | 68 | 202 | BB0744 | 336 | 455 | BG0765 | 574 | 696 |
| BA0745 | 69 | 203 | BB0751 | 337 | 456 | BG0773 | 575 | 697 |
| BA0748 | 70 | 204 | BB0754 | 338 | 457 | BG0776 | 576 | 698 |
| BA0754 | 71 | 205 | BB0760 | 339 | 458 | BG0784 | 577 | 699 |
| BA0759 | 72 | 206 | BB0765 | 340 | 459 | BG0788 | 578 | 700 |
| BA0767 | 73 | 207 | BB0772 | 341 | 460 | BG0796 | 579 | 701 |
| BA0778 | 74 | 208 | BB0783 | 342 | 461 | BG0807 | 580 | 702 |
| BA0784 | 75 | 209 | BB0789 | 343 | 462 | BG0814 | 581 | 703 |
| BA0790 | 76 | 210 | BB0794 | 344 | 463 | BG0820 | 582 | 704 |
| BA0792 | 77 | 211 | BB0796 | 345 | 464 | BG0822 | 583 | 705 |
| BA0829 | 78 | 212 | BB0832 | 346 | 465 | BG0857 | 584 | 706 |
| BAP001 | 79 | 213 | BB0844 | 347 | 466 | BGP096 | 585 | 707 |
| BAP002 | 80 | 214 | BBA03 | 348 | 467 | BGA02 | 586 | 708 |
| BAP003 | 81 | 215 | BBA04 | 349 | 468 | BGA03 | 587 | 709 |
| BAP004 | 82 | 216 | BBA21 | 350 | 469 | BGA19 | 588 | 710 |
| BAP005 | 83 | 217 | BBA24 | 351 | 470 | BGA21 | 589 | 711 |
| BAP006 | 84 | 218 | BBA34 | 352 | 471 | BGA28 | 590 | 712 |
| BAP007 | 85 | 219 | BBA36 | 353 | 472 | BGA30 | 591 | 713 |
| BAP008 | 86 | 220 | BBA57 | 354 | 473 | BGA58 | 592 | 714 |
| BAP009 | 87 | 221 | BBA73 | 355 | 474 | BGA73 | 593 | 715 |
| BAP010 | 88 | 222 | BBB07 | 356 | 475 | BGB07 | 594 | 716 |
| BAP011 | 89 | 223 | BBB16 | 357 | 476 | BGB15 | 595 | 717 |
| BAP012 | 90 | 224 | BBB17 | 358 | 477 | BGB16 | 596 | 718 |
| BAP013 | 91 | 225 | BBB19 | 359 | 478 | BGB18 | 597 | 719 |
| BAP014 | 92 | 226 | BBC01 | 360 | 479 | BGP276 | 598 | 720 |
| BAP015 | 93 | 227 | BBG10 | 361 | 480 | BGP027 | 599 | 721 |
| BAP016 | 94 | 228 | BBG12 | 362 | 481 | BGP025 | 600 | 722 |
| BAP017 | 95 | 229 | BBG21 | 363 | 482 | BGP016 | 601 | 723 |
| BAP018 | 96 | 230 | BBG23 | 364 | 483 | BGP013 | 602 | 724 |
| BAP019 | 97 | 231 | BBG24 | 365 | 484 | BGP012 | 603 | 725 |
| BAP020 | 98 | 232 | BBG30 | 366 | 485 | BGP003 | 604 | 726 |
| BAP021 | 99 | 233 | BBH13 | 367 | 486 | BGP289 | 605 | 727 |
| BAP022 | 100 | 234 | BBE02 | 368 | 487 | BGP199 | 606 | 728 |
| BAP023 | 101 | 235 | BBI38 | 369 | 488 | BGA66 | 607 | 729 |
| BAP024 | 102 | 236 | BBK32 | 370 | 489 | BGP100 | 608 | 730 |
| BAP025 | 103 | 237 | BBM06 | 371 | 490 | BGP040 | 609 | 731 |
| BAP026 | 104 | 238 | BBQ34 | 372 | 491 | BGP132 | 610 | 732 |
| BAP027 | 105 | 239 | BBM03 | 373 | 492 | BGP043 | 611 | 733 |
| BAP028 | 106 | 240 | BBR15 | 374 | 493 | BGP069 | 612 | 734 |
| BAP029 | 107 | 241 | BBM38 | 375 | 494 | BGP049 | 613 | 735 |
| BAP030 | 108 | 242 | BBN34 | 376 | 495 | BGP235 | 614 | 736 |
| BAP031 | 109 | 243 | BBO39 | 377 | 496 | BGP260 | 615 | 737 |
| BAP032 | 110 | 244 | BBP28 | 378 | 497 | BGP082 | 616 | 738 |
| BAP033 | 111 | 245 | BBQ03 | 379 | 498 | BGP310 | 617 | 739 |
| BAP034 | 112 | 246 | BBQ32 | 380 | 499 | BGP190 | 618 | 740 |
| BAP035 | 113 | 247 | BBS29 | 381 | 500 | BGP001 | 619 | 741 |
| BAP036 | 114 | 248 | BBR35 | 382 | 501 | BGP302 | 620 | 742 |
| BAP037 | 115 | 249 | BBN33 | 383 | 502 | BGP313 | 621 | 743 |
| BAP038 | 116 | 250 | BBS36 | 384 | 503 | BGP301 | 622 | 744 |
| BAP039 | 117 | 251 | no match | | | BGA26 | 623 | 745 |
| BAP040 | 118 | 252 | BBG15 | 385 | 504 | BGP022 | 624 | 746 |
| BAP041 | 119 | 253 | no match | | | BGP036 | 625 | 747 |
| BAP042 | 120 | 254 | BBK53 | 386 | 505 | BGP085 | 626 | 748 |
| BAP043 | 121 | 255 | BBG19 | 387 | 506 | BGP267 | 627 | 749 |
| BAP044 | 122 | 256 | no match | | | BGP321 | 628 | 750 |
| BAP045/ BBS42 | 123 | 257 | BBS42 | 123 | 257 | no match | | |
| CRFA006 | 124 | 258 | | | | | | |
| CRFA514 | 125 | 259 | | | | | | |
| CRFA554 | 126 | 260 | | | | | | |
| CRFA657 | 127 | 261 | | | | | | |
| CRFA744 | 128 | 262 | | | | | | |
| CRFA762 | 129 | 263 | | | | | | |
| CRFA780 | 130 | 264 | | | | | | |
| CRFBD21 | 131 | 265 | | | | | | |
| CRFBI14 | 132 | 266 | | | | | | |
| CRFBO17 | 133 | 267 | | | | | | |
| CRFP316 | 134 | 268 | | | | | | |

Table 3: List of Strains Used for Gene Distribution Analysis.

Table 3 shows the representation of different strains of *B. burgdorferi* s.l. isolates analysed for the gene distribution study. The genospecies, OspA and ospC types (Wilske et al., 1988; Livey et al., 1995) and the source of isolation are given (CSF; cerebrospinal fluid). In addition, the type of disease associated with the corresponding ospC type is given, H; non invasive disease, H Inv; invasive disease, —; not associated with disease in humans.

TABLE 3

| No. | Strain | Genospecies | OspA | ospC | Isolation | Disease |
|---|---|---|---|---|---|---|
| 1 | M76 | *B. garinii* | 6 | 020 | CSF | H Inv |
| 2 | W | *B. garinii* | 5 | 013 | CSF | H Inv |
| 3 | P | *B. afzelii* | 2 | 008 | Skin | H Inv |
| 4 | K6 | *B. garinii* | 6 | 019 | Skin | H Inv |
| 5 | K67 | *B. burgdorferi* s.s. | 1 | 047 | Skin | H |
| 6 | N40 | *B. burgdorferi* s.s. | 1 | 026 | *I. scapularis* | — |
| 7 | Sh-2-82 | *B. burgdorferi* s.s. | 1 | 030 | *I. scapularis* | H Inv |
| 8 | K86 | *B. burgdorferi* s.s. | 1 | 028 | Skin | H |
| 9 | LAS | *B. burgdorferi* s.s. | 1 | 002 | Skin | H Inv |
| 10 | HB19 | *B. burgdorferi* s.s. | 1 | 004 | Blood | H Inv |
| 11 | Lenz | *B. burgdorferi* s.s. | 1 | 002 | Myocardium | H Inv |
| 12 | 10/2002 | *B. afzelii* | 2 | 037 | Skin | H |
| 13 | BITS-B | *B. garinii* | 6 | 017 | *I. ricinus* | H Inv |
| 14 | 57 | *B. garinii* | 5 | 013 | CSF | H Inv |
| 15 | 60 | *B. garinii* | 6 | 012 | CSF | H Inv |
| 16 | 130/91 | *B. afzelii* | 2 | 010 | Skin | H |
| 17 | H13 | *B. garinii* | 6 | 025 | Heart | H Inv |
| 18 | K78 | *B. afzelii* | 2 | 007 | Skin | H |
| 19 | VS461 | *B. afzelii* | 2 | 022 | *I. ricinus* | H |
| 20 | B31 | *B. burgdorferi* s.s. | 1 | 002 | *I. scapularis* | H Inv |
| 21 | PKo | *B. afzelii* | 2 | 009 | Skin | H Inv |
| 22 | Z10 | *B. afzelii* | 2 | 034 | *I. ricinus* | H Inv |
| 23 | Bol10 | *B. garinii* | 3 | 023 | CSF | H Inv |
| 24 | ZS7 | *B. burgdorferi* s.s. | 1 | 001 | *I. ricinus* | H Inv |
| 25 | NBS16 | *B. garinii* | 3 | 033 | *I. ricinus* | H |
| 26 | KL11 | *B. garinii* | 6 | 019 | *I. ricinus* | H Inv |
| 27 | H9 | *B. afzelii* | 2 | 005 | Skin | H |
| 28 | 123/91 | *B. afzelii* | 2 | 011 | Skin | H |
| 29 | Simon | *B. afzelii* | 2 | 011 | Skin | H |
| 30 | ACA1 | *B. afzelii* | 2 | 008 | Skin | H Inv |

Table 4: Gene Distribution Analysis for a Selected Number of Antigens in Various Strains of the *B. burgdorferi* s.l. Strains.

Thirty *B. burgdorferi* s.l. strains as shown in Table 3 were tested by PCR with oligonucleotides specific for the genes encoding relevant antigens. The gene distribution table lists the number of positive PCR results from either the first 20 strains or all 30 strains and is an indication of the presence and conservation of the gene in diverse isolates of *B. burgdorferi* s.l. genospecies.

TABLE 4

| Ba ORF | Seq ID (DNA) | Gene distribution |
|---|---|---|
| BA0056 | 1 | 26/30 |
| BA0060 | 2 | 30/30 |
| BA0062 | 3 | 19/20 |
| BA0072 | 4 | 20/20 |
| BA0075 | 5 | 6/20 |
| BA0078 | 6 | 30/30 |
| BA0087 | 7 | 30/30 |
| BA0091 | 8 | 30/30 |
| BA0106 | 9 | 30/30 |
| BA0126 | 10 | 20/20 |
| BA0135 | 11 | 30/30 |
| BA0149 | 12 | 20/20 |
| BA0150 | 13 | 20/20 |
| BA0152 | 14 | 20/20 |
| BA0181 | 15 | 20/20 |
| BA0192 | 16 | 24/30 |
| BA0200 | 17 | 27/30 |
| BA0210 | 18 | 28/30 |
| BA0215 | 19 | 29/30 |
| BA0221 | 20 | 20/20 |
| BA0235 | 21 | 30/30 |
| BA0237 | 22 | 10/20 |
| BA0283 | 23 | 20/20 |
| BA0295 | 24 | 20/20 |
| BA0314 | 25 | 8/20 |
| BA0321 | 26 | 30/30 |
| BA0327 | 27 | 13/20 |
| BA0329 | 28 | 30/30 |
| BA0343 | 29 | 19/20 |
| BA0345 | 30 | 19/30 |
| BA0351 | 31 | 12/20 |
| BA0356 | 32 | 28/30 |
| BA0364 | 33 | 30/30 |
| BA0380 | 34 | 29/30 |
| BA0388 | 35 | 17/20 |
| BA0389 | 36 | 20/20 |
| BA0417 | 37 | 30/30 |
| BA0419 | 38 | 0/20 |
| BA0429 | 39 | 9/20 |
| BA0431 | 40 | 20/20 |
| BA0442 | 41 | 30/30 |
| BA0464 | 42 | 30/30 |
| BA0469 | 43 | 28/30 |
| BA0475 | 44 | 16/20 |
| BA0507 | 45 | 30/30 |
| BA0513 | 46 | 16/20 |
| BA0514 | 47 | 4/20 |
| BA0539 | 48 | 20/20 |
| BA0546 | 49 | 11/20 |
| BA0553 | 50 | 19/20 |
| BA0564 | 51 | 30/30 |
| BA0572 | 52 | 20/20 |
| BA0581 | 53 | 30/30 |
| BA0596 | 54 | 30/30 |
| BA0601 | 55 | 16/20 |
| BA0605 | 56 | 28/30 |
| BA0606 | 57 | 13/20 |
| BA0619 | 58 | 13/20 |
| BA0643 | 59 | 30/30 |
| BA0644 | 60 | 19/20 |
| BA0653 | 61 | 30/30 |
| BA0663 | 62 | 20/20 |
| BA0665 | 63 | 30/30 |
| BA0675 | 64 | 30/30 |
| BA0682 | 65 | 30/30 |
| BA0703 | 66 | 19/20 |
| BA0733 | 67 | 29/30 |
| BA0737 | 68 | 26/30 |
| BA0745 | 69 | 30/30 |
| BA0748 | 70 | 30/30 |
| BA0754 | 71 | 30/30 |
| BA0759 | 72 | 30/30 |
| BA0767 | 73 | 19/20 |
| BA0778 | 74 | 1/20 |
| BA0784 | 75 | 30/30 |
| BA0790 | 76 | 26/30 |
| BA0792 | 77 | 30/30 |
| BA0829 | 78 | 28/30 |
| BAP001 | 79 | 5/20 |
| BAP002 | 80 | 8/20 |
| BAP003 | 81 | 22/30 |
| BAP004 | 82 | 30/30 |
| BAP005 | 83 | 0/20 |
| BAP006 | 84 | 29/30 |

TABLE 4-continued

| Ba ORF | Seq ID (DNA) | Gene distribution |
|---|---|---|
| BAP007 | 85 | 30/30 |
| BAP008 | 86 | 8/20 |
| BAP009 | 87 | 11/20 |
| BAP011 | 89 | 4/20 |
| BAP012 | 90 | 20/20 |
| BAP013 | 91 | 30/30 |
| BAP014 | 92 | 12/30 |
| BAP015 | 93 | 11/20 |
| BAP016 | 94 | 13/20 |
| BAP017 | 95 | 12/20 |
| BAP018 | 96 | 2/20 |
| BAP019 | 97 | 11/20 |
| BAP020 | 98 | 0/30 |
| BAP021 | 99 | 22/30 |
| BAP022 | 100 | 26/30 |
| BAP023 | 101 | 26/30 |
| BAP024 | 102 | 18/30 |
| BAP025 | 103 | 30/30 |
| BAP026 | 104 | 8/20 |
| BAP027 | 105 | 26/30 |
| BAP028 | 106 | 8/20 |
| BAP029 | 107 | 6/30 |
| BAP030 | 108 | 11/20 |
| BAP031 | 109 | 8/20 |
| BAP032 | 110 | 0/20 |
| BAP033 | 111 | 12/20 |
| BAP034 | 112 | 10/20 |
| BAP035 | 113 | 9/20 |
| BAP036 | 114 | 10/20 |
| BAP037/ BAP038 | 115 116 | 4/20 |
| BAP039 | 117 | 0/20 |
| BAP040 | 118 | 0/20 |
| BAP041 | 119 | 0/20 |
| BAP042 | 120 | 3/20 |
| BAP043 | 121 | 28/30 |
| BAP044 | 122 | 1/20 |
| BAP045/ BBS42 | 123 | 9/20 |

Table 5: Immunogenicity of Epitopes in Mice.

B. burgdorferi s.l. antigens were tested for immunogenicity by immunization with E. coli clones harbouring plasmids encoding the platform proteins FhuA or LamB fused to B. burgdorferi s.l. peptides. The presence of epitope-specific antibodies was detected and measured by peptide ELISA. Results are expressed as − to ++++, and calculated as the sum of the reactivities of individual mouse sera based on OD405 nm (−; 0-0.1, +0.1-0.2, ++; 0.2-0.4, +++; 0.4-0.8, ++++, >0.8).

TABLE 5

| ORF | Seq ID (DNA) | Seq ID (Protein) | injection name | peptide name | Peptide ELISA | aa (start-stop) |
|---|---|---|---|---|---|---|
| BA0056 | 1 | 135 | Baf28 | BAObb0058.03 | ++ | 257-278 |
| BA0062 | 3 | 137 | Baf89 | BAObb0064.01 | +++ | 159-188 |
|  |  |  |  | BAObb0064.02 | ++ | 184-213 |
| BA0072 | 4 | 138 | Baf70 | BAObb0074.01 | ++ | 230-251 |
|  |  |  |  | BAObb0074.02 | ++++ | 247-267 |
| BA0075 | 5 | 139 | Baf104 | BAOba0077.01 | +++ | 138-164 |
|  |  |  |  | BAOba0077.02 | ++ | 160-187 |
| BA0078 | 6 | 140 | Baf77 | BAObb0081.01 | + | 97-120 |
|  |  |  |  | BAObb0081.02 | ++ | 116-139 |
|  |  |  |  | BAObb0081.03 | ++ | 135-158 |
|  |  |  |  | BAObb0081.04 | ++ | 154-177 |
| BA0087 | 7 | 141 | Baf127 | BAOba0089.01 | +++ | 160-187 |
| BA0106 | 9 | 143 | Baf83 | BAObb0109.01 | + | 165-192 |
|  |  |  |  | BAObb0109.02 | ++++ | 188-214 |
| BA0126 | 10 | 144 | Baf113 | BAOba0128.01 | + | 350-378 |
| BA0135 | 11 | 145 | Baf22 | BAOpbp-1.02 | +++ | 62-86 |
|  |  |  |  | BAOpbp-1.03 | + | 82-106 |
| BA0149 | 12 | 146 | Bafl1 | BAOflaB.01 | +++ | 18-42 |
|  |  |  |  | BAOflaB.02 | +++ | 38-62 |
|  |  |  |  | BAOflaB.04 | + | 78-102 |
|  |  |  |  | BAOflaB.05 | +++ | 98-122 |
|  |  |  |  | BAOflaB.06 | + | 118-142 |
|  |  |  |  | BAOflaB.07 | ++++ | 138-165 |
|  |  |  | Bafl2 | BAOflaB.09 | +++ | 275-297 |
|  |  |  |  | BAOflaB.10 | +++ | 293-315 |
|  |  |  |  | BAOflaB.12 | + | 185-211 |
|  |  |  |  | BAOflaB.13 | +++ | 207-233 |
|  |  |  |  | BAOflaB.14 | ++ | 229-255 |
| BA0150 | 13 | 147 | Baf23 | BAOfliD.01 | + | 22-50 |
|  |  |  |  | BAOfliD.02 | + | 46-75 |
|  |  |  |  | BAOfliD.03 | ++ | 110-131 |
|  |  |  |  | BAOfliD.04 | ++ | 127-148 |
|  |  |  | Baf24 | BAOfliD.07 | + | 344-367 |
|  |  |  |  | BAOfliD.08 | +++ | 361-384 |
|  |  |  |  | BAOfliD.09 | +++ | 382-405 |
|  |  |  |  | BAOfliD.10 | ++ | 401-424 |
| BA0152 | 14 | 148 | Baf114 | BAOba0155.03 | ++ | 304-328 |
| BA0181 | 15 | 149 | Baf35 | BAObb0181.01 | + | 6-29 |
|  |  |  |  | BAObb0181.04 | +++ | 68-92 |
|  |  |  |  | BAObb0181.05 | ++++ | 88-112 |
|  |  |  | Baf36 | BAObb0181.10 | +++ | 449-471 |
|  |  |  |  | BAObb0181.12 | ++ | 485-507 |

TABLE 5-continued

| ORF | Seq ID (DNA) | Seq ID (Protein) | injection name | peptide name | Peptide ELISA | aa (start-stop) |
|---|---|---|---|---|---|---|
| BA0210 | 18 | 152 | Baf1 | BAOlmp1.01 | +++ | 937-962 |
| | | | | BAOlmp1.02 | ++ | 958-983 |
| | | | Baf2 | BAOlmp1.03 | +++ | 102-130 |
| | | | | BAOlmp1.04 | +++ | 126-154 |
| BA0215 | 19 | 153 | Baf71 | BAObb0215.01 | ++ | 80-103 |
| | | | | BAObb0215.02 | ++ | 99-122 |
| | | | | BAObb0215.03 | ++ | 118-141 |
| | | | | BAObb0215.04 | ++ | 137-159 |
| BA0221 | 20 | 154 | Baf26 | BAOfliG-1.04 | +++ | 270-299 |
| BA0235 | 21 | 155 | Baf105 | BAOba0242.01 | + | 126-153 |
| | | | | BAOba0242.03 | ++ | 172-200 |
| BA0237 | 22 | 156 | Baf15 | BAObb0238.01 | + | 15-40 |
| | | | | BAObb0238.02 | +++ | 36-61 |
| | | | | BAObb0238.03 | + | 57-82 |
| | | | | BAObb0238.04 | +++ | 78-103 |
| | | | | BAObb0238.05 | ++++ | 99-124 |
| BA0283 | 23 | 157 | Baf37 | BAObb0283.01 | + | 35-63 |
| | | | | BAObb0283.03 | +++ | 82-109 |
| BA0321 | 26 | 160 | Baf58 | BAObb0323.06 | +++ | 298-327 |
| BA0327 | 27 | 161 | Baf18 | BAOoppA-2.01 | +++ | 20-43 |
| | | | | BAOoppA-2.02 | + | 39-62 |
| | | | | BAOoppA-2.03 | +++ | 58-79 |
| | | | Baf19 | BAOoppA-2.12 | ++ | 354-377 |
| | | | Baf20 | BAOoppA-2.13 | + | 404-431 |
| | | | | BAOoppA-2.14 | ++ | 427-453 |
| | | | | BAOoppA-2.15 | ++ | 449-475 |
| | | | | BAOoppA-2.16 | +++ | 471-498 |
| | | | | BAOoppA-2.17 | + | 494-521 |
| BA0329 | 28 | 162 | Baf34 | BAOoppA-3.01 | ++ | 40-62 |
| | | | | BAOoppA-3.02 | + | 58-80 |
| | | | | BAOoppA-3.03 | + | 76-97 |
| | | | | BAOoppA-3.04 | ++++ | 251-276 |
| | | | | BAOoppA-3.05 | ++++ | 272-297 |
| | | | | BAOoppA-3.06 | +++ | 291-316 |
| | | | | BAOoppA-3.08 | + | 333-358 |
| BA0351 | 31 | 165 | Baf38 | BAObb0353.01 | ++ | 197-222 |
| | | | | BAObb0353.03 | ++ | 239-264 |
| | | | | BAObb0353.04 | + | 260-284 |
| BA0356 | 32 | 166 | Baf55 | BAObb0359.01 | ++++ | 378-402 |
| | | | | BAObb0359.04 | + | 438-461 |
| BA0364 | 33 | 167 | Baf93 | BAOba0378.01 | ++++ | 82-107 |
| | | | | BAOba0378.02 | ++++ | 103-127 |
| | | | | BAOba0378.03 | + | 212-235 |
| | | | | BAOba0378.04 | + | 231-253 |
| BA0388 | 35 | 169 | Baf107 | BAOba0402.01 | ++++ | 1053-1082 |
| BA0389 | 36 | 170 | Baf118 | BAOba0403.05 | +++ | 270-292 |
| BA0417 | 37 | 171 | Baf78 | BAObb0418.01 | ++ | 44-65 |
| | | | | BAObb0418.02 | + | 61-82 |
| | | | | BAObb0418.03 | + | 78-99 |
| BA0419 | 38 | 172 | Baf59 | BAObb0420.01 | ++ | 1230-1254 |
| BA0429 | 39 | 173 | Baf97 | BAOba0444.01 | + | 110-131 |
| BA0431 | 40 | 174 | Baf84 | BAObb0436.01 | ++++ | 372-395 |
| | | | | BAObb0436.03 | +++ | 410-434 |
| BA0442 | 41 | 175 | Baf85 | BAObb0446.01 | + | 439-464 |
| BA0464 | 42 | 176 | Baf98 | BAOba0480.03 | + | 52-77 |
| BA0469 | 43 | 177 | Baf108 | BAOba0485.01 | ++++ | 281-300 |
| | | | | BAOba0485.02 | +++ | 296-316 |
| BA0475 | 44 | 178 | Baf99 | BAOba0491.01 | ++ | 33-57 |
| | | | | BAOba0491.02 | ++ | 53-78 |
| BA0507 | 45 | 179 | Baf39 | BAObb0512.01 | ++ | 718-744 |
| | | | | BAObb0512.02 | ++ | 740-766 |
| | | | | BAObb0512.03 | + | 762-788 |
| BA0513 | 46 | 180 | Baf64 | BAObb0518.01 | + | 66-93 |
| | | | | BAObb0518.02 | + | 89-116 |
| | | | | BAObb0518.03 | ++++ | 112-139 |
| | | | | BAObb0518.04 | ++ | 135-161 |
| BA0539 | 48 | 182 | Baf119 | BAOba0557.01 | ++ | 171-197 |
| BA0553 | 50 | 184 | Baf90 | BAOba0573.01 | ++ | 102-127 |
| | | | | BAOba0573.02 | + | 123-148 |
| | | | | BAOba0573.03 | ++++ | 144-170 |
| BA0581 | 53 | 187 | Baf86 | BAObb0588.01 | + | 91-114 |
| | | | | BAObb0588.02 | + | 110-133 |

TABLE 5-continued

| ORF | Seq ID (DNA) | Seq ID (Protein) | injection name | peptide name | Peptide ELISA | aa (start-stop) |
|---|---|---|---|---|---|---|
| BA0596 | 54 | 188 | Baf40 | BAOp66.01 | ++ | 36-60 |
| | | | | BAOp66.02 | ++ | 56-80 |
| | | | | BAOp66.03 | + | 76-100 |
| | | | | BAOp66.04 | + | 96-119 |
| | | | Baf41 | BAOp66.05 | ++++ | 343-371 |
| | | | | BAOp66.06 | +++ | 367-394 |
| BA0605 | 56 | 190 | Baf42 | BAObb0612.01 | ++ | 156-183 |
| | | | | BAObb0612.02 | + | 179-206 |
| | | | | BAObb0612.03 | + | 202-229 |
| | | | | BAObb0612.04 | ++ | 225-252 |
| | | | | BAObb0612.05 | ++ | 248-274 |
| BA0619 | 58 | 192 | Baf30 | BAOamds.02 | ++ | 98-125 |
| | | | | BAOamds.03 | + | 121-148 |
| | | | | BAOamds.04 | + | 144-170 |
| | | | | BAOamds.05 | + | 165-187 |
| | | | | BAOamds.07 | + | 201-223 |
| | | | Baf31 | BAOamds.08 | +++ | 285-309 |
| BA0643 | 59 | 193 | Baf129 | BAOba0670.01 | + | 390-409 |
| BA0644 | 60 | 194 | Baf72 | BAObb0649.01 | + | 6-33 |
| | | | | BAObb0649.02 | ++ | 29-55 |
| | | | | BAObb0649.03 | + | 52-79 |
| | | | | BAObb0649.04 | + | 74-100 |
| BA0653 | 61 | 195 | Baf43 | BAObb0658.02 | ++ | 172-200 |
| | | | | BAObb0658.03 | ++ | 196-223 |
| BA0663 | 62 | 196 | Baf44 | BAOflaA.01 | +++ | 12-39 |
| | | | | BAOflaA.02 | +++ | 35-62 |
| | | | | BAOflaA.03 | ++++ | 58-84 |
| | | | | BAOflaA.04 | + | 156-179 |
| | | | | BAOflaA.05 | +++ | 175-197 |
| BA0675 | 64 | 198 | Baf45 | BAObb0680.01 | + | 28-53 |
| | | | | BAObb0680.02 | + | 49-73 |
| | | | | BAObb0680.03 | ++ | 165-188 |
| | | | | BAObb0680.04 | + | 184-207 |
| | | | | BAObb0680.05 | ++ | 203-226 |
| | | | | BAObb0680.06 | +++ | 292-320 |
| | | | | BAObb0680.07 | + | 316-344 |
| | | | | BAObb0680.08 | ++ | 531-560 |
| | | | | BAObb0680.09 | + | 556-584 |
| | | | | BAObb0680.10 | + | 580-608 |
| BA0703 | 66 | 200 | Baf101 | BAObb0710.02 | ++ | 200-228 |
| BA0737 | 68 | 202 | Baf16 | BAOp83.06 | +++ | 348-374 |
| BA0745 | 69 | 203 | Baf110 | BAOba0779.01 | +++ | 116-143 |
| | | | | BAOba0779.02 | ++++ | 139-166 |
| BA0748 | 70 | 204 | Baf87 | BAObb0754.01 | ++ | 203-227 |
| BA0759 | 72 | 206 | Baf46 | BAObb0765.01 | + | 183-208 |
| | | | | BAObb0765.02 | ++ | 204-229 |
| | | | | BAObb0765.03 | ++++ | 225-250 |
| BA0778 | 74 | 208 | Baf47 | BAObb0783.03 | ++++ | 359-384 |
| BA0784 | 75 | 209 | Baf96 | BAOba0819.01 | + | 353-378 |
| | | | | BAOba0819.02 | ++++ | 374-399 |
| | | | | BAOba0819.03 | +++ | 395-419 |
| BA0790 | 76 | 210 | Baf48 | BAObb0794.03 | + | 1372-1398 |
| | | | | BAObb0794.04 | ++ | 1394-1419 |
| BA0792 | 77 | 211 | Baf49 | BAObb0796.01 | +++ | 14-38 |
| | | | | BAObb0796.02 | +++ | 34-58 |
| | | | | BAObb0796.03 | + | 54-78 |
| BA0829 | 78 | 212 | Baf111 | BAObb0832.02 | + | 95-122 |
| | | | | BAObb0832.03 | + | 118-146 |
| BAP001 | 79 | 213 | Baf69 | BAObgp096.01 | + | 20-44 |
| | | | | BAObgp096.02 | + | 40-64 |
| | | | | BAObgp096.03 | + | 60-84 |
| | | | | BAObgp096.04 | +++ | 80-104 |
| | | | | BAObgp096.05 | + | 138-162 |
| | | | | BAObgp096.06 | + | 158-182 |
| | | | | BAObgp096.07 | + | 178-201 |
| BAP002 | 80 | 214 | Baf65 | BAObba03.01 | +++ | 41-67 |
| | | | | BAObba03.02 | +++ | 63-89 |
| | | | | BAObba03.03 | ++++ | 85-111 |
| | | | | BAObba03.04 | ++++ | 107-133 |
| BAP003 | 81 | 215 | Baf80 | BAObba04.01 | +++ | 165-185 |
| | | | | BAObba04.02 | + | 181-200 |
| BAP005 | 83 | 217 | Baf66 | BAObba24.01 | +++ | 15-44 |
| | | | | BAObba24.02 | +++ | 40-68 |
| | | | | BAObba24.03 | + | 64-92 |

TABLE 5-continued

| ORF | Seq ID (DNA) | Seq ID (Protein) | injection name | peptide name | Peptide ELISA | aa (start-stop) |
|---|---|---|---|---|---|---|
| BAP006 | 84 | 218 | Baf25 | BAOoppA-4.01 | + | 335-360 |
| | | | | BAOoppA-4.02 | + | 356-381 |
| | | | | BAOoppA-4.03 | + | 422-446 |
| | | | | BAOoppA-4.04 | + | 442-465 |
| BAP007 | 85 | 219 | Baf67 | BAObba36.01 | + | 50-74 |
| | | | | BAObba36.02 | + | 70-94 |
| | | | | BAObba36.03 | + | 90-114 |
| | | | | BAObba36.04 | + | 110-133 |
| | | | | BAObba36.06 | + | 164-192 |
| | | | | BAObba36.07 | + | 188-215 |
| BAP008 | 86 | 220 | Baf91 | BAObba57.01 | ++++ | 91-116 |
| | | | | BAObba57.02 | ++++ | 112-137 |
| | | | | BAObba57.03 | + | 133-158 |
| | | | | BAObba57.04 | ++++ | 154-179 |
| BAP012 | 90 | 224 | Baf122 | BAObbb17.01 | +++ | 331-352 |
| BAP013 | 91 | 225 | Baf94 | BAObbb19.01 | + | 116-143 |
| | | | | BAObbb19.02 | ++++ | 139-166 |
| | | | | BAObbb19.03 | ++++ | 162-189 |
| | | | | BAObbb19.04 | ++++ | 185-212 |
| BAP015 | 93 | 227 | Baf6 | BAObgp027.19 | +++ | 3-27 |
| | | | Baf7 | BAObgp027.08 | +++ | 616-640 |
| | | | | BAObgp027.09 | + | 636-659 |
| | | | | BAObgp027.10 | + | 655-678 |
| | | | | BAObgp027.12 | ++ | 576-598 |
| | | | | BAObgp027.13 | + | 594-615 |
| | | | | BAObgp027.14 | +++ | 611-632 |
| | | | Baf8 | BAObgp027.01 | + | 693-718 |
| | | | | BAObgp027.02 | + | 714-739 |
| BAP016 | 94 | 228 | Baf123 | BAObbg12.01 | ++++ | 32-45 |
| BAP017 | 95 | 229 | Baf3 | BAObbg21.01 | ++++ | 112-135 |
| | | | | BAObbg21.02 | +++ | 131-153 |
| | | | | BAObbg21.04 | + | 324-349 |
| | | | | BAObbg21.05 | + | 345-370 |
| | | | | BAObbg21.06 | + | 366-391 |
| BAP018 | 96 | 230 | Baf63 | BAObbg23.02 | + | 122-143 |
| | | | | BAObbg23.04 | + | 170-195 |
| BAP019 | 97 | 231 | Baf4 | BAObbg24.04 | +++ | 377-400 |
| | | | | BAObbg24.05 | +++ | 396-419 |
| | | | Baf5 | BAObbg24.02 | ++++ | 91-115 |
| | | | | BAObbg24.03 | ++++ | 111-135 |
| BAP021 | 99 | 233 | Baf73 | BAObbg33.01 | +++ | 3-27 |
| | | | | BAObbg33.02 | ++ | 23-47 |
| | | | | BAObbg33.03 | + | 43-68 |
| | | | Baf143 | BAObbh13.01 | +++ | 4-30 |
| | | | | BAObbh13.02 | +++ | 26-52 |
| BAP022 | 100 | 234 | Baf50 | BAObbh09.04 | ++++ | 400-429 |
| | | | | BAObbh09.05 | + | 521-545 |
| BAP023 | 101 | 235 | Baf81 | BAObbj41.01 | +++ | 61-84 |
| | | | | BAObbj41.02 | + | 80-103 |
| | | | | BAObbj41.03 | ++++ | 99-122 |
| BAP024 | 102 | 236 | Baf13 | BAOp35.01 | + | 8-31 |
| | | | | BAOp35.07 | ++ | 124-149 |
| | | | Baf14 | BAOp35.09 | ++ | 166-191 |
| | | | | BAOp35.11 | + | 207-232 |
| | | | | BAOp35.12 | ++ | 265-294 |
| | | | | BAOp35.13 | +++ | 290-318 |
| BAP025 | 103 | 237 | Baf51 | BAObbl06.01 | ++++ | 20-43 |
| | | | | BAObbl06.02 | ++ | 39-62 |
| | | | | BAObbl06.03 | + | 95-122 |
| | | | | BAObbl06.04 | +++ | 117-143 |
| | | | Baf75 | BAObbq13.01 | ++ | 133-159 |
| | | | | BAObbq13.02 | +++ | 155-181 |
| BAP026 | 104 | 238 | Baf88 | BAObbr27.01 | +++ | 1-29 |
| BAP027 | 105 | 239 | Baf103 | BAObgp043.01 | + | 121-143 |
| | | | | BAObgp043.02 | + | 139-160 |
| | | | | BAObgp043.03 | +++ | 156-178 |
| BAP028 | 106 | 240 | Baf57 | BAObbn15.01 | ++++ | 195-219 |
| BAP030 | 108 | 242 | Baf52 | BAObbo34.01 | +++ | 4-32 |
| | | | | BAObbo34.02 | + | 27-54 |
| | | | | BAObbo34.03 | ++++ | 50-77 |
| BAP031 | 109 | 243 | Baf92 | BAObbs41.01 | +++ | 160-186 |
| | | | | BAObbs41.02 | + | 182-208 |
| | | | Baf54 | BAObbr42.01 | +++ | 122-149 |
| BAP032 | 110 | 244 | Baf74 | BAObbp28.01 | ++++ | 48-73 |
| | | | | BAObbp28.02 | +++ | 69-94 |

TABLE 5-continued

| ORF | Seq ID (DNA) | Seq ID (Protein) | injection name | peptide name | Peptide ELISA | aa (start-stop) |
|---|---|---|---|---|---|---|
| BAP033 | 111 | 245 | Baf32 | BAOomp.04 | +++ | 151-173 |
| BAP034 | 112 | 246 | Baf53 | BAObbq32.01 | +++ | 14-41 |
| | | | | BAObbq32.02 | +++ | 37-63 |
| BAP035 | 113 | 247 | Baf125 | BAObgp001.01 | +++ | 7-30 |
| | | | | BAObgp001.02 | +++ | 26-49 |
| | | | | BAObgp001.03 | ++ | 45-69 |
| BAP036 | 114 | 248 | Baf112 | BAObbr35.01 | ++ | 1-21 |
| | | | | BAObbr35.02 | ++ | 17-44 |
| BAP038 | 116 | 250 | Baf10 | BAObbs36.03 | + | 43-66 |
| BAP039 | 117 | 251 | Baf124 | BAObga26.02 | ++++ | 47-71 |
| | | | | BAObga26.03 | ++++ | 67-91 |
| BAP040 | 118 | 252 | Baf126 | BAObgp022.02 | +++ | 39-60 |
| | | | | BAObgp022.03 | ++++ | 56-78 |
| BAP041 | 119 | 253 | Baf142 | BAObgp036.03 | +++ | 199-224 |
| BAP042 | 120 | 254 | Baf76 | BAObgp085.01 | +++ | 70-94 |
| | | | | BAObgp085.02 | ++++ | 90-113 |
| BAP043 | 121 | 255 | Baf68 | BAObbq34.03 | ++ | 48-70 |
| BAP044 | 122 | 256 | Baf95 | BAObgp321.01 | + | 1-25 |
| | | | | BAObgp321.02 | + | 21-45 |
| | | | | BAObgp321.03 | ++ | 41-65 |
| BAP045 | 123 | 257 | Baf102 | BAObbs42.01 | ++ | 27-51 |

Table 6: Peptide ELISA with Peptides Derived from *B. burgdorferi* s.l.

The "Sum" represents the number of sera, for which the OD405 nm measurement was at least 0.05 OD units above the blank without coating. "From aa" and "To aa" denotes the position of the peptide relative to the full length protein as listed under the respective sequence identification number (Seq ID). ELISA experiments were preformed with peptides derived from *B. burgdorferi* s.l. and 22 human sera (P1755, P1766, P1772, P1806, P1811, P3055, P3144, P3186, P3219, P3017, P3084, P3288, P3150, P3301, P3344, P3394, P3183, P3336, P1789, P1796, P1938, P1941).

TABLE 6

| Peptide | Ba ORF | Seq ID | Sum | From aa | To aa |
|---|---|---|---|---|---|
| BAOamds.02 | BA0619 | 192 | 2 | 98 | 125 |
| BAOamds.04 | BA0619 | 192 | 7 | 144 | 170 |
| BAOamds.05 | BA0619 | 192 | 4 | 165 | 187 |
| BAOamds.07 | BA0619 | 192 | 14 | 201 | 223 |
| BAOamds.08 | BA0619 | 192 | 15 | 285 | 309 |
| BAOamds.09 | BA0619 | 192 | 9 | 305 | 329 |
| BAOamds.10 | BA0619 | 192 | 7 | 325 | 348 |
| BAOamds.11 | BA0619 | 192 | 19 | 400 | 425 |
| BAOamds.12 | BA0619 | 192 | 8 | 513 | 541 |
| BAOamds.13 | BA0619 | 192 | 2 | 537 | 564 |
| BAOamds.14 | BA0619 | 192 | 2 | 560 | 587 |
| BAOamds.15 | BA0619 | 192 | 3 | 583 | 610 |
| BAOba0077.01 | BA0075 | 139 | 20 | 138 | 164 |
| BAOba0077.02 | BA0075 | 139 | 14 | 160 | 187 |
| BAOba0089.01 | BA0087 | 141 | 12 | 160 | 187 |
| BAOba0128.01 | BA0126 | 144 | 15 | 350 | 378 |
| BAOba0128.02 | BA0126 | 144 | 18 | 374 | 402 |
| BAOba0128.03 | BA0126 | 144 | 9 | 398 | 426 |
| BAOba0128.04 | BA0126 | 144 | 17 | 422 | 451 |
| BAOba0155.01 | BA0152 | 148 | 3 | 264 | 288 |
| BAOba0155.02 | BA0152 | 148 | 11 | 284 | 308 |
| BAOba0155.03 | BA0152 | 148 | 10 | 304 | 328 |
| BAOba0198.01 | BA0192 | 150 | 8 | 77 | 91 |
| BAOba0207.01 | BA0200 | 151 | 10 | 111 | 134 |
| BAOba0242.01 | BA0235 | 155 | 6 | 126 | 153 |
| BAOba0242.02 | BA0235 | 155 | 11 | 149 | 176 |
| BAOba0242.03 | BA0235 | 155 | 17 | 172 | 200 |
| BAOba0303.01 | BA0295 | 158 | 12 | 220 | 245 |
| BAOba0303.02 | BA0295 | 158 | 10 | 241 | 266 |
| BAOba0303.03 | BA0295 | 158 | 4 | 262 | 288 |
| BAOba0323.01 | BA0314 | 159 | 1 | 31 | 53 |

TABLE 6-continued

| Peptide | Ba ORF | Seq ID | Sum | From aa | To aa |
|---|---|---|---|---|---|
| BAOba0323.02 | BA0314 | 159 | 13 | 49 | 71 |
| BAOba0323.03 | BA0314 | 159 | 20 | 67 | 89 |
| BAOba0356.01 | BA0343 | 163 | 13 | 258 | 280 |
| BAOba0356.02 | BA0343 | 163 | 10 | 276 | 298 |
| BAOba0356.03 | BA0343 | 163 | 12 | 294 | 317 |
| BAOba0356.04 | BA0343 | 163 | 11 | 313 | 336 |
| BAOba0358.01 | BA0345 | 164 | 13 | 458 | 472 |
| BAOba0378.01 | BA0364 | 167 | 8 | 82 | 107 |
| BAOba0378.02 | BA0364 | 167 | 14 | 103 | 127 |
| BAOba0378.02 | BA0364 | 167 | 7 | 103 | 127 |
| BAOba0378.03 | BA0364 | 167 | 13 | 212 | 235 |
| BAOba0378.03 | BA0364 | 167 | 2 | 212 | 235 |
| BAOba0378.04 | BA0364 | 167 | 18 | 231 | 253 |
| BAOba0378.04 | BA0364 | 167 | 4 | 231 | 253 |
| BAOba0394.01 | BA0380 | 168 | 12 | 26 | 51 |
| BAOba0394.02 | BA0380 | 168 | 10 | 47 | 73 |
| BAOba0402.01 | BA0388 | 169 | 6 | 1053 | 1082 |
| BAOba0403.01 | BA0389 | 170 | 5 | 194 | 217 |
| BAOba0403.02 | BA0389 | 170 | 17 | 213 | 236 |
| BAOba0403.03 | BA0389 | 170 | 15 | 232 | 255 |
| BAOba0403.04 | BA0389 | 170 | 5 | 251 | 274 |
| BAOba0403.05 | BA0389 | 170 | 15 | 270 | 292 |
| BAOba0444.01 | BA0429 | 173 | 10 | 110 | 131 |
| BAOba0444.02 | BA0429 | 173 | 4 | 179 | 201 |
| BAOba0444.03 | BA0429 | 173 | 11 | 197 | 219 |
| BAOba0444.04 | BA0429 | 173 | 2 | 215 | 236 |
| BAOba0480.01 | BA0464 | 176 | 5 | 12 | 36 |
| BAOba0480.02 | BA0464 | 176 | 3 | 32 | 56 |
| BAOba0480.03 | BA0464 | 176 | 11 | 52 | 77 |
| BAOba0485.01 | BA0469 | 177 | 12 | 281 | 300 |
| BAOba0485.02 | BA0469 | 177 | 16 | 296 | 316 |
| BAOba0491.01 | BA0475 | 178 | 12 | 33 | 57 |
| BAOba0491.02 | BA0475 | 178 | 4 | 53 | 78 |
| BAOba0557.01 | BA0539 | 182 | 9 | 171 | 197 |
| BAOba0557.02 | BA0539 | 182 | 7 | 193 | 219 |
| BAOba0557.03 | BA0539 | 182 | 6 | 215 | 240 |
| BAOba0565.01 | BA0546 | 183 | 13 | 363 | 388 |
| BAOba0565.02 | BA0546 | 183 | 20 | 384 | 409 |
| BAOba0565.03 | BA0546 | 183 | 4 | 405 | 430 |
| BAOba0573.01 | BA0553 | 184 | 5 | 102 | 127 |
| BAOba0573.02 | BA0553 | 184 | 5 | 123 | 148 |
| BAOba0573.03 | BA0553 | 184 | 7 | 144 | 170 |
| BAOba0584.01 | BA0564 | 185 | 13 | 149 | 163 |
| BAOba0623.01 | BA0601 | 189 | 1 | 342 | 366 |
| BAOba0623.02 | BA0601 | 189 | 14 | 362 | 386 |
| BAOba0670.01 | BA0643 | 193 | 17 | 390 | 409 |
| BAOba0692.01 | BA0665 | 197 | 9 | 50 | 64 |

TABLE 6-continued

| Peptide | Ba ORF | Seq ID | Sum | From aa | To aa |
|---|---|---|---|---|---|
| BAOba0710.01 | BA0682 | 199 | 5 | 223 | 249 |
| BAOba0710.02 | BA0682 | 199 | 13 | 245 | 272 |
| BAOba0765.01 | BA0733 | 201 | 9 | 117 | 131 |
| BAOba0779.01 | BA0745 | 203 | 15 | 116 | 143 |
| BAOba0779.02 | BA0745 | 203 | 3 | 139 | 166 |
| BAOba0789.01 | BA0754 | 205 | 3 | 1 | 21 |
| BAOba0802.01 | BA0767 | 207 | 10 | 245 | 270 |
| BAOba0802.02 | BA0767 | 207 | 11 | 266 | 291 |
| BAOba0802.03 | BA0767 | 207 | 6 | 287 | 312 |
| BAOba0802.04 | BA0767 | 207 | 3 | 308 | 332 |
| BAOba0819.01 | BA0784 | 209 | 2 | 353 | 378 |
| BAOba0819.02 | BA0784 | 209 | 16 | 374 | 399 |
| BAOba0819.03 | BA0784 | 209 | 8 | 395 | 419 |
| BAObb0832.02 | BA0829 | 212 | 7 | 95 | 122 |
| BAObb0832.03 | BA0829 | 212 | 14 | 118 | 146 |
| BAObb0058.01 | BA0056 | 135 | 17 | 128 | 151 |
| BAObb0058.02 | BA0056 | 135 | 6 | 146 | 169 |
| BAObb0058.06 | BA0056 | 135 | 2 | 314 | 336 |
| BAObb0058.07 | BA0056 | 135 | 12 | 339 | 361 |
| BAObb0058.08 | BA0056 | 135 | 15 | 357 | 379 |
| BAObb0064.01 | BA0062 | 137 | 6 | 159 | 188 |
| BAObb0064.02 | BA0062 | 137 | 6 | 184 | 213 |
| BAObb0074.01 | BA0072 | 138 | 9 | 230 | 251 |
| BAObb0074.02 | BA0072 | 138 | 2 | 247 | 267 |
| BAObb0081.01 | BA0078 | 140 | 1 | 97 | 120 |
| BAObb0081.02 | BA0078 | 140 | 2 | 116 | 139 |
| BAObb0081.03 | BA0078 | 140 | 5 | 135 | 158 |
| BAObb0081.04 | BA0078 | 140 | 2 | 154 | 177 |
| BAObb0094.01 | BA0091 | 142 | 6 | 195 | 228 |
| BAObb0109.01 | BA0106 | 143 | 8 | 165 | 192 |
| BAObb0109.02 | BA0106 | 143 | 6 | 188 | 214 |
| BAObb0181.01 | BA0181 | 149 | 10 | 6 | 29 |
| BAObb0181.02 | BA0181 | 149 | 4 | 25 | 47 |
| BAObb0181.03 | BA0181 | 149 | 10 | 43 | 65 |
| BAObb0181.04 | BA0181 | 149 | 1 | 68 | 92 |
| BAObb0181.06 | BA0181 | 149 | 17 | 262 | 288 |
| BAObb0181.08 | BA0181 | 149 | 7 | 306 | 331 |
| BAObb0181.09 | BA0181 | 149 | 2 | 326 | 351 |
| BAObb0181.10 | BA0181 | 149 | 2 | 449 | 471 |
| BAObb0181.11 | BA0181 | 149 | 1 | 467 | 489 |
| BAObb0181.12 | BA0181 | 149 | 3 | 485 | 507 |
| BAObb0215.01 | BA0215 | 153 | 5 | 80 | 103 |
| BAObb0215.02 | BA0215 | 153 | 1 | 99 | 122 |
| BAObb0215.03 | BA0215 | 153 | 5 | 118 | 141 |
| BAObb0215.04 | BA0215 | 153 | 15 | 137 | 159 |
| BAObb0238.01 | BA0237 | 156 | 2 | 15 | 40 |
| BAObb0238.02 | BA0237 | 156 | 16 | 36 | 61 |
| BAObb0238.03 | BA0237 | 156 | 9 | 57 | 82 |
| BAObb0238.04 | BA0237 | 156 | 3 | 78 | 103 |
| BAObb0238.05 | BA0237 | 156 | 5 | 99 | 124 |
| BAObb0238.06 | BA0237 | 156 | 7 | 120 | 146 |
| BAObb0283.01 | BA0283 | 157 | 4 | 35 | 63 |
| BAObb0283.02 | BA0283 | 157 | 2 | 59 | 86 |
| BAObb0283.04 | BA0283 | 157 | 3 | 187 | 213 |
| BAObb0283.05 | BA0283 | 157 | 2 | 209 | 235 |
| BAObb0283.07 | BA0283 | 157 | 3 | 252 | 277 |
| BAObb0323.01 | BA0321 | 160 | 10 | 83 | 108 |
| BAObb0323.02 | BA0321 | 160 | 11 | 104 | 129 |
| BAObb0323.03 | BA0321 | 160 | 8 | 125 | 150 |
| BAObb0323.04 | BA0321 | 160 | 7 | 146 | 172 |
| BAObb0323.05 | BA0321 | 160 | 7 | 272 | 302 |
| BAObb0323.06 | BA0321 | 160 | 9 | 298 | 327 |
| BAObb0353.01 | BA0351 | 165 | 13 | 197 | 222 |
| BAObb0353.02 | BA0351 | 165 | 16 | 218 | 243 |
| BAObb0353.03 | BA0351 | 165 | 15 | 239 | 264 |
| BAObb0353.04 | BA0351 | 165 | 16 | 260 | 284 |
| BAObb0359.01 | BA0356 | 166 | 16 | 378 | 402 |
| BAObb0359.02 | BA0356 | 166 | 17 | 398 | 422 |
| BAObb0359.03 | BA0356 | 166 | 18 | 418 | 442 |
| BAObb0359.04 | BA0356 | 166 | 17 | 438 | 461 |
| BAObb0418.01 | BA0417 | 171 | 15 | 44 | 65 |
| BAObb0418.02 | BA0417 | 171 | 1 | 61 | 82 |
| BAObb0418.03 | BA0417 | 171 | 1 | 78 | 99 |
| BAObb0420.01 | BA0419 | 172 | 5 | 1230 | 1254 |
| BAObb0420.02 | BA0419 | 172 | 7 | 150 | 1275 |
| BAObb0436.01 | BA0431 | 174 | 7 | 372 | 395 |
| BAObb0436.02 | BA0431 | 174 | 4 | 391 | 414 |
| BAObb0436.03 | BA0431 | 174 | 5 | 410 | 434 |
| BAObb0446.01 | BA0442 | 175 | 5 | 439 | 464 |
| BAObb0512.01 | BA0507 | 179 | 17 | 718 | 744 |
| BAObb0512.02 | BA0507 | 179 | 15 | 740 | 766 |
| BAObb0512.03 | BA0507 | 179 | 17 | 762 | 788 |
| BAObb0512.04 | BA0507 | 179 | 17 | 906 | 931 |
| BAObb0512.05 | BA0507 | 179 | 17 | 927 | 951 |
| BAObb0512.06 | BA0507 | 179 | 17 | 947 | 971 |
| BAObb0518.01 | BA0513 | 180 | 1 | 66 | 93 |
| BAObb0518.04 | BA0513 | 180 | 1 | 135 | 161 |
| BAObb0518.05 | BA0513 | 180 | 2 | 494 | 518 |
| BAObb0519.01 | BA0514 | 181 | 7 | 40 | 61 |
| BAObb0519.02 | BA0514 | 181 | 11 | 57 | 79 |
| BAObb0519.03 | BA0514 | 181 | 8 | 75 | 97 |
| BAObb0579.01 | BA0572 | 186 | 2 | 440 | 462 |
| BAObb0579.02 | BA0572 | 186 | 4 | 458 | 480 |
| BAObb0579.03 | BA0572 | 186 | 2 | 476 | 497 |
| BAObb0588.01 | BA0581 | 187 | 5 | 91 | 114 |
| BAObb0588.02 | BA0581 | 187 | 5 | 110 | 133 |
| BAObb0588.03 | BA0581 | 187 | 4 | 129 | 152 |
| BAObb0588.04 | BA0581 | 187 | 3 | 148 | 170 |
| BAObb0612.01 | BA0605 | 190 | 16 | 156 | 183 |
| BAObb0612.02 | BA0605 | 190 | 12 | 179 | 206 |
| BAObb0612.03 | BA0605 | 190 | 16 | 202 | 229 |
| BAObb0612.04 | BA0605 | 190 | 17 | 225 | 252 |
| BAObb0612.05 | BA0605 | 190 | 15 | 248 | 274 |
| BAObb0613.01 | BA0606 | 191 | 11 | 747 | 773 |
| BAObb0613.02 | BA0606 | 191 | 13 | 769 | 795 |
| BAObb0649.01 | BA0644 | 194 | 9 | 6 | 33 |
| BAObb0649.02 | BA0644 | 194 | 9 | 29 | 55 |
| BAObb0649.03 | BA0644 | 194 | 13 | 52 | 79 |
| BAObb0649.04 | BA0644 | 194 | 2 | 74 | 100 |
| BAObb0658.01 | BA0653 | 195 | 15 | 148 | 176 |
| BAObb0658.02 | BA0653 | 195 | 16 | 172 | 200 |
| BAObb0658.03 | BA0653 | 195 | 16 | 196 | 223 |
| BAObb0680.01 | BA0675 | 198 | 14 | 28 | 53 |
| BAObb0680.02 | BA0675 | 198 | 15 | 49 | 73 |
| BAObb0680.03 | BA0675 | 198 | 17 | 165 | 188 |
| BAObb0680.05 | BA0675 | 198 | 16 | 203 | 226 |
| BAObb0680.06 | BA0675 | 198 | 2 | 292 | 320 |
| BAObb0680.07 | BA0675 | 198 | 1 | 316 | 344 |
| BAObb0680.08 | BA0675 | 198 | 2 | 531 | 560 |
| BAObb0710.01 | BA0703 | 200 | 5 | 180 | 208 |
| BAObb0710.02 | BA0703 | 200 | 5 | 200 | 228 |
| BAObb0754.01 | BA0748 | 204 | 4 | 203 | 227 |
| BAObb0754.02 | BA0748 | 204 | 9 | 223 | 247 |
| BAObb0754.03 | BA0748 | 204 | 4 | 243 | 267 |
| BAObb0754.04 | BA0748 | 204 | 6 | 263 | 287 |
| BAObb0783.02 | BA0778 | 208 | 2 | 339 | 363 |
| BAObb0783.03 | BA0778 | 208 | 1 | 359 | 384 |
| BAObb0794.03 | BA0790 | 210 | 7 | 1372 | 1398 |
| BAObb0796.01 | Ba0792 | 211 | 16 | 14 | 38 |
| BAObb0796.02 | BA0792 | 211 | 3 | 34 | 58 |
| BAObb0796.04 | BA0792 | 211 | 7 | 74 | 98 |
| BAObb0796.05 | BA0792 | 211 | 2 | 94 | 117 |
| BAObba03.01 | BAP002 | 214 | 1 | 41 | 67 |
| BAObba03.02 | BAP002 | 214 | 3 | 63 | 89 |
| BAObba03.05 | BAP002 | 214 | 1 | 129 | 155 |
| BAObba04.01 | BAP003 | 215 | 1 | 165 | 185 |
| BAObba04.02 | BAP003 | 215 | 5 | 181 | 200 |
| BAObba21.01 | BAP004 | 216 | 5 | 26 | 44 |
| BAObba24.01 | BAP005 | 217 | 3 | 15 | 44 |
| BAObba24.02 | BAP005 | 217 | 2 | 40 | 68 |
| BAObba24.03 | BAP005 | 217 | 1 | 64 | 92 |
| BAObba36.03 | BAP007 | 219 | 1 | 90 | 114 |
| BAObba36.04 | BAP007 | 219 | 1 | 110 | 133 |
| BAObba36.05 | BAP007 | 219 | 2 | 140 | 168 |
| BAObba36.06 | BAP007 | 219 | 2 | 164 | 192 |
| BAObba36.07 | BAP007 | 219 | 2 | 188 | 215 |
| BAObba57.01 | BAP008 | 220 | 4 | 91 | 116 |
| BAObba57.02 | BAP008 | 220 | 6 | 112 | 137 |
| BAObba57.03 | BAP008 | 220 | 6 | 133 | 158 |
| BAObba57.04 | BAP008 | 220 | 8 | 154 | 179 |
| BAObbb16.01 | BAP011 | 223 | 8 | 311 | 338 |
| BAObbb16.02 | BAP011 | 223 | 6 | 334 | 361 |
| BAObbb16.03 | BAP011 | 223 | 9 | 357 | 385 |
| BAObbb16.04 | BAP011 | 223 | 7 | 381 | 409 |

TABLE 6-continued

| Peptide | Ba ORF | Seq ID | Sum | From aa | To aa | Peptide | Ba ORF | Seq ID | Sum | From aa | To aa |
|---|---|---|---|---|---|---|---|---|---|---|---|
| BAObbb16.05 | BAP011 | 223 | 8 | 405 | 433 | BAObbs36.08 | BAP037/8 | 249 | 8 | 103 | 129 |
| BAObbb17.01 | BAP012 | 224 | 9 | 331 | 352 | BAObbs41.01 | BAP031 | 243 | 8 | 160 | 186 |
| BAObbb17.02 | BAP012 | 224 | 9 | 348 | 369 | BAObbs41.02 | BAP031 | 243 | 6 | 182 | 208 |
| BAObbb17.03 | BAP012 | 224 | 4 | 365 | 386 | BAObbs42.01 | BAP045 | 257 | 20 | 27 | 51 |
| BAObbb19.01 | BAP013 | 225 | 12 | 116 | 143 | BAObbs42.02 | BAP045 | 257 | 10 | 47 | 72 |
| BAObbb19.01 | BAP013 | 225 | 6 | 116 | 143 | BAObg0061.01 | BA0060 | 136 | 10 | 177 | 191 |
| BAObbb19.02 | BAP013 | 225 | 14 | 139 | 166 | BAObga26.01 | BAP039 | 251 | 4 | 27 | 51 |
| BAObbb19.02 | BAP013 | 225 | 2 | 139 | 166 | BAObga26.02 | BAP039 | 251 | 7 | 47 | 71 |
| BAObbb19.03 | BAP013 | 225 | 20 | 162 | 189 | BAObga26.03 | BAP039 | 251 | 5 | 67 | 91 |
| BAObbb19.03 | BAP013 | 225 | 9 | 162 | 189 | BAObgp001.01 | BAP035 | 247 | 5 | 7 | 30 |
| BAObbb19.04 | BAP013 | 225 | 17 | 185 | 212 | BAObgp001.02 | BAP035 | 247 | 8 | 26 | 49 |
| BAObbb19.04 | BAP013 | 225 | 9 | 185 | 212 | BAObgp001.03 | BAP035 | 247 | 3 | 45 | 69 |
| BAObbc01.01 | BAP014 | 226 | 3 | 208 | 230 | BAObgp001.04 | BAP035 | 247 | 9 | 65 | 89 |
| BAObbg12.01 | BAP016 | 228 | 5 | 32 | 45 | BAObgp003.01 | BAP020 | 232 | 9 | 126 | 137 |
| BAObbg12.02 | BAP016 | 228 | 4 | 50 | 72 | BAObgp022.01 | BAP040 | 252 | 2 | 22 | 43 |
| BAObbg21.02 | BAP017 | 229 | 3 | 131 | 153 | BAObgp022.02 | BAP040 | 252 | 8 | 39 | 60 |
| BAObbg21.03 | BAP017 | 229 | 9 | 149 | 172 | BAObgp022.03 | BAP040 | 252 | 10 | 56 | 78 |
| BAObbg21.04 | BAP017 | 229 | 5 | 324 | 349 | BAObgp027.01 | BAP015 | 227 | 7 | 693 | 718 |
| BAObbg21.05 | BAP017 | 229 | 1 | 345 | 370 | BAObgp027.02 | BAP015 | 227 | 6 | 714 | 739 |
| BAObbg21.06 | BAP017 | 229 | 14 | 366 | 391 | BAObgp027.03 | BAP015 | 227 | 3 | 438 | 460 |
| BAObbg23.01 | BAP018 | 230 | 8 | 104 | 126 | BAObgp027.04 | BAP015 | 227 | 1 | 456 | 477 |
| BAObbg23.02 | BAP018 | 230 | 6 | 122 | 143 | BAObgp027.05 | BAP015 | 227 | 10 | 473 | 495 |
| BAObbg23.03 | BAP018 | 230 | 7 | 148 | 174 | BAObgp027.06 | BAP015 | 227 | 3 | 806 | 828 |
| BAObbg23.04 | BAP018 | 230 | 2 | 170 | 195 | BAObgp027.07 | BAP015 | 227 | 9 | 824 | 846 |
| BAObbg24.02 | BAP019 | 231 | 15 | 91 | 115 | BAObgp027.08 | BAP015 | 227 | 11 | 616 | 640 |
| BAObbg24.03 | BAP019 | 231 | 13 | 111 | 135 | BAObgp027.09 | BAP015 | 227 | 7 | 636 | 659 |
| BAObbg24.04 | BAP019 | 231 | 5 | 377 | 400 | BAObgp027.10 | BAP015 | 227 | 9 | 655 | 678 |
| BAObbg24.05 | BAP019 | 231 | 13 | 396 | 419 | BAObgp027.11 | BAP015 | 227 | 8 | 674 | 697 |
| BAObbg24.06 | BAP019 | 231 | 3 | 532 | 553 | BAObgp027.12 | BAP015 | 227 | 8 | 576 | 598 |
| BAObbg24.07 | BAP019 | 231 | 3 | 548 | 569 | BAObgp027.13 | BAP015 | 227 | 5 | 594 | 615 |
| BAObbg24.08 | BAP019 | 231 | 2 | 715 | 744 | BAObgp027.14 | BAP015 | 227 | 7 | 611 | 632 |
| BAObbg24.09 | BAP019 | 231 | 4 | 740 | 768 | BAObgp027.15 | BAP015 | 227 | 6 | 851 | 877 |
| BAObbg33.01 | BAP021 | 233 | 7 | 3 | 27 | BAObgp027.16 | BAP015 | 227 | 8 | 873 | 898 |
| BAObbg33.02 | BAP021 | 233 | 7 | 23 | 47 | BAObgp027.17 | BAP015 | 227 | 9 | 731 | 760 |
| BAObbg33.03 | BAP021 | 233 | 2 | 43 | 68 | BAObgp027.18 | BAP015 | 227 | 10 | 756 | 784 |
| BAObbh09.02 | BAP022 | 234 | 2 | 118 | 141 | BAObgp027.19 | BAP015 | 227 | 2 | 3 | 27 |
| BAObbh09.03 | BAP022 | 234 | 8 | 137 | 160 | BAObgp027.20 | BAP015 | 227 | 5 | 23 | 48 |
| BAObbh09.05 | BAP022 | 234 | 1 | 521 | 545 | BAObgp027.21 | BAP015 | 227 | 3 | 957 | 982 |
| BAObbh13.01 | BAP021 | 233 | 4 | 4 | 30 | BAObgp027.22 | BAP015 | 227 | 18 | 978 | 1002 |
| BAObbh13.02 | BAP021 | 233 | 6 | 26 | 52 | BAObgp036.01 | BAP041 | 253 | 14 | 157 | 182 |
| BAObbh13.03 | BAP021 | 233 | 3 | 48 | 75 | BAObgp036.02 | BAP041 | 253 | 5 | 178 | 203 |
| BAObbj41.01 | BAP023 | 235 | 5 | 61 | 84 | BAObgp036.03 | BAP041 | 253 | 5 | 199 | 224 |
| BAObbj41.02 | BAP023 | 235 | 8 | 80 | 103 | BAObgp036.04 | BAP041 | 253 | 4 | 220 | 246 |
| BAObbj41.03 | BAP023 | 235 | 1 | 99 | 122 | BAObgp085.01 | BAP042 | 254 | 13 | 70 | 94 |
| BAObbl06.01 | BAP025 | 237 | 5 | 20 | 43 | BAObgp085.02 | BAP042 | 254 | 2 | 90 | 113 |
| BAObbl06.02 | BAP025 | 237 | 17 | 39 | 62 | BAObgp096.01 | BAP001 | 213 | 19 | 20 | 44 |
| BAObbl06.03 | BAP025 | 237 | 4 | 95 | 122 | BAObgp096.02 | BAP001 | 213 | 7 | 40 | 64 |
| BAObbl06.04 | BAP025 | 237 | 16 | 117 | 143 | BAObgp096.03 | BAP001 | 213 | 16 | 60 | 84 |
| BAObbn15.01 | BAP028 | 240 | 11 | 195 | 219 | BAObgp096.04 | BAP001 | 213 | 5 | 80 | 104 |
| BAObbn15.02 | BAP028 | 240 | 10 | 215 | 239 | BAObgp096.05 | BAP001 | 213 | 4 | 138 | 162 |
| BAObbn15.03 | BAP028 | 240 | 8 | 235 | 259 | BAObgp096.06 | BAP001 | 213 | 14 | 158 | 182 |
| BAObbo34.02 | BAP030 | 242 | 2 | 27 | 54 | BAObgp096.07 | BAP001 | 213 | 6 | 178 | 201 |
| BAObbo40.01 | BAP029 | 241 | 5 | 197 | 217 | BAObgp321.01 | BAP044 | 256 | 13 | 1 | 25 |
| BAObbo40.02 | BAP029 | 241 | 3 | 213 | 232 | BAObgp321.02 | BAP044 | 256 | 17 | 21 | 45 |
| BAObbp28.01 | BAP032 | 244 | 1 | 48 | 73 | BAObgp321.03 | BAP044 | 256 | 17 | 41 | 65 |
| BAObbp28.02 | BAP032 | 244 | 2 | 69 | 94 | BAObgp43.01 | BAP027 | 239 | 3 | 121 | 143 |
| BAObbp28.03 | BAP032 | 244 | 1 | 90 | 114 | BAObgp43.02 | BAP027 | 239 | 12 | 139 | 160 |
| BAObbq13.01 | BAP025 | 237 | 2 | 133 | 159 | BAObgp43.03 | BAP027 | 239 | 19 | 156 | 178 |
| BAObbq13.02 | BAP025 | 237 | 7 | 155 | 181 | BAOflaA.01 | BA0663 | 196 | 17 | 12 | 39 |
| BAObbq32.01 | BAP034 | 246 | 1 | 14 | 41 | BAOflaA.03 | BA0663 | 196 | 2 | 35 | 62 |
| BAObbq32.02 | BAP034 | 246 | 2 | 37 | 63 | BAOflaA.03 | BA0663 | 196 | 8 | 58 | 84 |
| BAObbq34.02 | BAP043 | 255 | 17 | 29 | 52 | BAOflaA.05 | BA0663 | 196 | 16 | 175 | 197 |
| BAObbq34.03 | BAP043 | 255 | 9 | 48 | 70 | BAOflaB.01 | BA0149 | 146 | 12 | 18 | 42 |
| BAObbr27.01 | BAP026 | 238 | 9 | 1 | 29 | BAOflaB.02 | BA0149 | 146 | 3 | 38 | 62 |
| BAObbr27.02 | BAP026 | 238 | 5 | 24 | 53 | BAOflaB.03 | BA0149 | 146 | 2 | 58 | 82 |
| BAObbr27.03 | BAP026 | 238 | 3 | 49 | 76 | BAOflaB.04 | BA0149 | 146 | 15 | 78 | 102 |
| BAObbr35.01 | BAP036 | 248 | 17 | 1 | 21 | BAOflaB.05 | BA0149 | 146 | 2 | 98 | 122 |
| BAObbr35.02 | BAP036 | 248 | 17 | 17 | 44 | BAOflaB.06 | BA0149 | 146 | 4 | 118 | 142 |
| BAObbr42.01 | BAP031 | 243 | 2 | 122 | 149 | BAOflaB.07 | BA0149 | 146 | 5 | 138 | 165 |
| BAObbr42.02 | BAP031 | 243 | 2 | 145 | 172 | BAOflaB.08 | BA0149 | 146 | 1 | 256 | 279 |
| BAObbs36.01 | BAP037/8 | 249 | 1 | 3 | 27 | BAOflaB.09 | BA0149 | 146 | 6 | 275 | 297 |
| BAObbs36.02 | BAP037/8 | 249 | 11 | 23 | 47 | BAOflaB.10 | BA0149 | 146 | 1 | 293 | 315 |
| BAObbs36.03 | BAP037/8 | 249 | 2 | 43 | 66 | BAOflaB.11 | BA0149 | 146 | 9 | 163 | 189 |
| BAObbs36.04 | BAP037/8 | 249 | 1 | 62 | 85 | BAOflaB.12 | BA0149 | 146 | 12 | 185 | 211 |
| BAObbs36.05 | BAP037/8 | 249 | 1 | 136 | 165 | BAOflaB.13 | BA0149 | 146 | 14 | 207 | 233 |
| BAObbs36.06 | BAP037/8 | 249 | 17 | 156 | 185 | BAOflaB.14 | BA0149 | 146 | 1 | 229 | 255 |
| BAObbs36.07 | BAP037/8 | 249 | 0 | 81 | 107 | BAOfliD.02 | BA0150 | 147 | 3 | 46 | 75 |

TABLE 6-continued

| Peptide | Ba ORF | Seq ID | Sum | From aa | To aa |
|---|---|---|---|---|---|
| BAOfliD.03 | BA0150 | 147 | 2 | 110 | 131 |
| BAOfliD.04 | BA0150 | 147 | 4 | 127 | 148 |
| BAOfliD.05 | BA0150 | 147 | 7 | 188 | 216 |
| BAOfliD.06 | BA0150 | 147 | 1 | 212 | 240 |
| BAOfliD.07 | BA0150 | 147 | 1 | 344 | 367 |
| BAOfliD.08 | BA0150 | 147 | 5 | 361 | 384 |
| BAOfliD.09 | BA0150 | 147 | 3 | 382 | 405 |
| BAOfliD.10 | BA0150 | 147 | 1 | 401 | 424 |
| BAOfliG-1.01 | BA0221 | 154 | 9 | 151 | 180 |
| BAOfliG-1.02 | BA0221 | 154 | 7 | 176 | 205 |
| BAOfliG-1.03 | BA0221 | 154 | 10 | 245 | 274 |
| BAOfliG-1.04 | BA0221 | 154 | 16 | 270 | 299 |
| BAOlmp1.01 | BA0210 | 152 | 6 | 937 | 962 |
| BAOlmp1.02 | BA0210 | 152 | 4 | 958 | 983 |
| BAOlmp1.03 | BA0210 | 152 | 2 | 102 | 130 |
| BAOlmp1.04 | BA0210 | 152 | 1 | 126 | 154 |
| BAOlmp1.05 | BA0210 | 152 | 2 | 150 | 177 |
| BAOlmp1.06 | BA0210 | 152 | 2 | 823 | 849 |
| BAOlmp1.07 | BA0210 | 152 | 2 | 845 | 872 |
| BAOlmp1.08 | BA0210 | 152 | 3 | 867 | 892 |
| BAOlmp1.09 | BA0210 | 152 | 2 | 285 | 314 |
| BAOlmp1.10 | BA0210 | 152 | 5 | 310 | 339 |
| BAOlmp1.11 | BA0210 | 152 | 3 | 335 | 364 |
| BAOomp.01 | BAP033 | 245 | 3 | 97 | 119 |
| BAOomp.02 | BAP033 | 245 | 4 | 115 | 137 |
| BAOomp.03 | BAP033 | 245 | 1 | 133 | 155 |
| BAOomp.04 | BAP033 | 245 | 5 | 151 | 173 |
| BAOoppA-2.01 | BA0327 | 161 | 2 | 20 | 43 |
| BAOoppA-2.02 | BA0327 | 161 | 1 | 39 | 62 |
| BAOoppA-2.03 | BA0327 | 161 | 1 | 58 | 79 |
| BAOoppA-2.04 | BA0327 | 161 | 9 | 69 | 94 |
| BAOoppA-2.05 | BA0327 | 161 | 3 | 90 | 115 |
| BAOoppA-2.06 | BA0327 | 161 | 4 | 167 | 189 |
| BAOoppA-2.07 | BA0327 | 161 | 11 | 185 | 207 |
| BAOoppA-2.08 | BA0327 | 161 | 14 | 203 | 224 |
| BAOoppA-2.09 | BA0327 | 161 | 9 | 296 | 320 |
| BAOoppA-2.10 | BA0327 | 161 | 9 | 316 | 339 |
| BAOoppA-2.11 | BA0327 | 161 | 10 | 335 | 358 |
| BAOoppA-2.12 | BA0327 | 161 | 9 | 354 | 377 |
| BAOoppA-2.13 | BA0327 | 161 | 10 | 404 | 431 |
| BAOoppA-2.14 | BA0327 | 161 | 8 | 427 | 453 |
| BAOoppA-2.15 | BA0327 | 161 | 15 | 449 | 475 |
| BAOoppA-2.16 | BA0327 | 161 | 16 | 471 | 498 |
| BAOoppA-2.17 | BA0327 | 161 | 9 | 494 | 521 |
| BAOoppA-3.01 | BA0329 | 162 | 1 | 40 | 62 |
| BAOoppA-3.03 | BA0329 | 162 | 1 | 76 | 97 |
| BAOoppA-3.04 | BA0329 | 162 | 1 | 251 | 276 |
| BAOoppA-3.05 | BA0329 | 162 | 15 | 272 | 297 |
| BAOoppA-3.06 | BA0329 | 162 | 17 | 291 | 316 |
| BAOoppA-3.08 | BA0329 | 162 | 1 | 333 | 358 |
| BAOoppA-4.01 | BAP006 | 218 | 16 | 335 | 360 |
| BAOoppA-4.02 | BAP006 | 218 | 6 | 356 | 381 |
| BAOoppA-4.03 | BAP006 | 218 | 2 | 422 | 446 |
| BAOoppA-4.04 | BAP006 | 218 | 6 | 442 | 465 |
| BAOoppA-4.05 | BAP006 | 218 | 1 | 461 | 484 |
| BAOp35.03 | BAP024 | 236 | 1 | 46 | 69 |
| BAOp35.04 | BAP024 | 236 | 11 | 65 | 88 |
| BAOp35.05 | BAP024 | 236 | 11 | 84 | 107 |
| BAOp35.07 | BAP024 | 236 | 1 | 124 | 149 |
| BAOp35.10 | BAP024 | 236 | 4 | 186 | 211 |
| BAOp35.11 | BAP024 | 236 | 13 | 207 | 232 |
| BAOp35.12 | BAP024 | 236 | 12 | 265 | 294 |
| BAOp35.13 | BAP024 | 236 | 1 | 290 | 318 |
| BAOp66.02 | BA0596 | 188 | 2 | 56 | 80 |
| BAOp66.03 | BA0596 | 188 | 1 | 76 | 100 |
| BAOp66.04 | BA0596 | 188 | 16 | 96 | 119 |
| BAOp66.05 | BA0596 | 188 | 3 | 343 | 371 |
| BAOp66.06 | BA0596 | 188 | 4 | 367 | 394 |
| BAOp66.07 | BA0596 | 188 | 3 | 410 | 436 |
| BAOp66.08 | BA0596 | 188 | 1 | 432 | 457 |
| BAOp83.03 | BA0737 | 202 | 2 | 281 | 307 |
| BAOp83.13 | BA0737 | 202 | 1 | 631 | 654 |
| BAOpbp-1.01 | BA0135 | 145 | 10 | 41 | 66 |
| BAOpbp-1.02 | BA0135 | 145 | 9 | 62 | 86 |
| BAOpbp-1.03 | BA0135 | 145 | 2 | 82 | 106 |
| BAOpbp-1.04 | BA0135 | 145 | 3 | 102 | 126 |
| BAOpbp-1.05 | BA0135 | 145 | 2 | 417 | 444 |
| BAOpbp-1.06 | BA0135 | 145 | 2 | 440 | 466 |
| BAOpbp-1.07 | BA0135 | 145 | 6 | 528 | 554 |
| BAOpbp-1.08 | BA0135 | 145 | 18 | 550 | 575 |
| BAOpbp-1.09 | BA0135 | 145 | 3 | 571 | 596 |

Table 7: FACS Analysis with Epitope Sera Generated in Mice.

The epitope specific antibodies in mice sera were tested in FACS analysis for binding to the surface of *B. afzelii* strain K78 cells. The sera that showed a significant shift in FACS analysis are listed. The percentage indicates the number of cells that showed a shift in the FACS analysis in comparison to cells incubated without immune sera.

TABLE 7

| ORF | Seq ID (Protein) | Injection name | FACS |
|---|---|---|---|
| BA0056 | 135 | Baf28 | 91% |
|  |  | Baf29 | 90% |
| BA0135 | 145 | Baf22 | 75% |
| BA0149 | 146 | Baf11 | 60% |
|  |  | Baf12 | 46% |
| BA0150 | 147 | Baf23 | 23% |
|  |  | Baf24 | 43% |
| BA0181 | 149 | Baf36 | 62% |
| BA0210 | 152 | Baf1 | 36% |
|  |  | Baf2 | 80% |
| BA0221 | 154 | Baf26 | 87% |
| BA0237 | 156 | Baf15 | 28% |
| BA0283 | 157 | Baf37 | 62% |
| BA0327 | 161 | Baf18 | 77% |
|  |  | Baf19 | 58% |
| BA0329 | 162 | Baf34 | 25% |
| BA0469 | 177 | Baf108 | 20% |
| BA0507 | 179 | Baf39 | 21% |
| BA0596 | 188 | Baf40 | 30% |
|  |  | Baf41 | 27% |
| BA0605 | 190 | Baf42 | 45% |
| BA0619 | 192 | Baf30 | 24% |
| BA0653 | 195 | Baf43 | 48% |
| BA0737 | 202 | Baf16 | 83% |
| BA0767 | 207 | Baf121 | 27% |
| BA0790 | 210 | Baf48 | 67% |
| BAP006 | 218 | Baf25 | 30% |
| BAP015 | 227 | Baf6 | 76% |
|  |  | Baf8 | 21% |
| BAP019 | 231 | Baf4 | 64% |
|  |  | Baf5 | 86% |
| BAP021 | 233 | Baf143 | 26% |
| BAP022 | 234 | Baf50 | 28% |
| BAP024 | 236 | Baf13 | 96% |
| BAP025 | 237 | Baf75 | 22% |
| BAP030 | 242 | Baf52 | 22% |
| BAP033 | 245 | Baf2 | 74% |
| BAP034 | 246 | Baf53 | 39% |
| BAP035 | 247 | Baf125 | 20% |
| BAP037/ BAP038 | 249 250 | Baf10 | 86% |

Table 8: Expressed and Purified Proteins Tested in Animals.

The table lists the expressed and purified proteins which were tested in the *Borrelia* animal model. Ba: *Borrelia afzelii*, ORF: open reading frame, BB: beta barrel, SP: signal peptide, LP: signal peptide for lipidation, Mw: molecular weight, kDa: kilo Dalton.

TABLE 8

| Ba ORF | amino acid SEQ ID NO: | Common name | Motifs | Mw (kDa) | Protein Construct | Amino acid From-To | Purification status |
|---|---|---|---|---|---|---|---|
| BA0056 | 135 | hypothetical protein | BB | 76.5 | BB0058-1 | 91-415 | Insoluble |
| BA0210 | 152 | surface-located membrane protein 1 (lmp1) | SP | 128.2 | Bbu0210-1 | 27-246 | Soluble |
| BA0210 | 152 | surface-located membrane protein 1 (lmp1) | SP | 128.2 | Bbu0210-2 | 701-1067 | Insoluble |
| BA0221 | 154 | flagellar motor switch protein (fliG-1) |  | 47.9 | Baf0221 | 1-408 | Insoluble |
| BA0237 | 156 | hypothetical protein | SP | 30.5 | Baf0237 | 21-257 | Insoluble |
| BA0507 | 179 | hypothetical protein |  | 254.2 | Baf0512-2 | 399-870 | Insoluble |
| BA0581 | 187 | pfs protein (pfs-2) | SP | 29.2 | Baf0581 | 22-264 | Insoluble |
| BA0605 | 190 | ATP-dependent Clp protease, subunit X (clpX) |  | 47.7 | Baf0627 | 1-430 | Insoluble |
| BA0675 | 198 | methyl-accepting chemotaxis protein (mcp-4) | SP | 84.7 | Bbu0680-2 | 391-753 | Insoluble |
| BA0790 | 210 | hypothetical protein | BB, SP | 168.9 | BB0794-3 | 979-1467 | Insoluble |
| BAP006 | 218 | oligopeptide ABC transporter, periplasmic oligopeptide-binding protein (oppAV) | LP | 61.1 | BbuA0034-1 | 251-528 | Insoluble |

Table 9: Most Probable Number of Cells (from Norman, R. L. and Kempe, L. L., 1960).

This table shows the most probable number of cells (MPN#) with 95% confidence limits (95% CL). The most probable number of bacteria is read from the table by comparing the number of wells with live bacteria (Positive) for the different dilutions with the entries in the table. The MPN is the number of cells at the lowest dilution (10 cells/well).

TABLE 9

| Positive 10; 1; 0.1 | MPN# | 95% CL |
|---|---|---|
| 8 8 7 | 208 | 80.9-535 |
| 8 8 6 | 139 | 54.1-357 |
| 8 8 5 | 98.2 | 38.2-252 |
| 8 8 4 | 70.2 | 27.3-180 |
| 8 8 3 | 51.0 | 19.8-131 |
| 8 8 2 | 38.5 | 15.0-98.9 |
| 8 8 1 | 30.1 | 11.7-77.4 |
| 8 8 0 | 24.0 | 9.34-61.7 |
| 8 7 8 | 59.6 | 23.2-153 |
| 8 7 7 | 50.8 | 19.8-131 |
| 8 7 6 | 43.3 | 16.8-111 |
| 8 7 5 | 36.9 | 14.4-94.8 |
| 8 7 4 | 31.4 | 12.2-80.7 |
| 8 7 3 | 26.7 | 10.4-68.6 |
| 8 7 2 | 22.6 | 8.79-58.1 |
| 8 7 1 | 19.1 | 7.43-49.1 |
| 8 7 0 | 15.9 | 6.19-40.9 |
| 8 6 6 | 28.4 | 11.1-73.0 |
| 8 6 5 | 25.0 | 9.73-64.3 |
| 8 6 4 | 21.8 | 8.48-56.0 |
| 8 6 3 | 18.9 | 7.35-48.6 |
| 8 6 2 | 16.3 | 6.34-41.9 |
| 8 6 1 | 13.8 | 5.37-35.5 |
| 8 6 0 | 11.5 | 4.47-29.6 |
| 8 5 5 | 18.9 | 7.35-48.6 |
| 8 5 4 | 16.6 | 6.46-42.7 |
| 8 5 3 | 14.4 | 5.60-37.0 |
| 8 5 2 | 12.3 | 4.79-31.6 |
| 8 5 1 | 10.3 | 4.01-26.5 |
| 8 5 0 | 8.42 | 3.28-21.6 |
| 8 4 5 | 14.8 | 5.76-38.0 |
| 8 4 4 | 13.0 | 5.06-33.4 |
| 8 4 3 | 11.1 | 4.32-28.5 |
| 8 4 2 | 9.40 | 3.66-24.2 |
| 8 4 1 | 7.74 | 3.01-19.9 |
| 8 4 0 | 6.22 | 2.42-16.0 |
| 8 3 5 | 11.8 | 4.59-30.3 |
| 8 3 4 | 10.2 | 3.97-26.2 |
| 8 3 3 | 8.67 | 3.37-22.3 |
| 8 3 2 | 7.18 | 2.79-18.5 |
| 8 3 1 | 5.82 | 2.26-15.0 |
| 8 3 0 | 4.67 | 1.82-12.0 |
| 8 2 4 | 8.07 | 3.14-20.7 |
| 8 2 3 | 6.72 | 2.61-17.3 |
| 8 2 2 | 5.50 | 2.14-14.1 |
| 8 2 1 | 4.45 | 1.73-11.4 |
| 8 2 0 | 3.62 | 1.41-9.30 |
| 8 1 3 | 5.22 | 2.03-13.4 |
| 8 1 2 | 4.27 | 1.66-11.0 |
| 8 1 1 | 3.50 | 1.36-9.00 |
| 8 1 0 | 2.87 | 1.12-7.38 |
| 8 0 2 | 3.38 | 1.32-8.69 |
| 8 0 1 | 2.80 | 1.09-7.20 |
| 8 0 0 | 2.31 | 0.90-5.94 |
| 7 7 1 | 5.47 | 2.13-14.1 |
| 7 7 0 | 4.84 | 1.88-12.4 |
| 7 6 2 | 5.30 | 2.06-13.6 |
| 7 6 1 | 4.71 | 1.83-12.1 |
| 7 6 0 | 4.15 | 1.61-10.7 |
| 7 5 2 | 4.58 | 1.78-11.8 |
| 7 5 1 | 4.04 | 1.57-10.4 |
| 7 5 0 | 3.55 | 1.38-9.12 |
| 7 4 3 | 4.46 | 1.74-11.5 |
| 7 4 2 | 3.95 | 1.54-10.2 |
| 7 4 1 | 3.47 | 1.35-8.92 |
| 7 4 0 | 3.04 | 1.18-7.81 |
| 7 3 3 | 3.86 | 1.50-9.92 |
| 7 3 2 | 3.40 | 1.32-8.74 |
| 7 3 1 | 2.98 | 1.16-7.66 |

TABLE 9-continued

| Positive 10; 1; 0.1 | MPN# | 95% CL |
|---|---|---|
| 7 3 0 | 2.59 | 1.01-6.66 |
| 7 2 3 | 3.33 | 1.30-8.56 |
| 7 2 2 | 2.92 | 1.14-7.50 |
| 7 2 1 | 2.55 | 0.99-6.55 |
| 7 2 0 | 2.20 | 0.86-5.65 |
| 7 1 3 | 2.87 | 1.12-7.38 |
| 7 1 2 | 2.51 | 0.98-6.45 |
| 7 1 1 | 2.17 | 0.84-5.58 |
| 7 1 0 | 1.86 | 0.72-4.78 |
| 7 0 2 | 2.14 | 0.83-5.50 |
| 7 0 1 | 1.83 | 0.71-4.70 |
| 7 0 0 | 1.55 | 0.60-3.98 |
| 6 6 1 | 3.08 | 1.20-7.92 |
| 6 6 0 | 2.77 | 1.08-7.12 |
| 6 5 1 | 2.73 | 1.06-7.02 |
| 6 5 0 | 2.44 | 0.95-6.27 |
| 6 4 2 | 2.96 | 1.05-6.91 |
| 6 4 1 | 2.41 | 0.94-6.19 |
| 6 4 0 | 2.14 | 0.83-5.50 |
| 6 3 2 | 2.38 | 0.93-6.12 |
| 6 3 1 | 2.11 | 0.82-5.42 |
| 6 3 0 | 1.86 | 0.72-4.78 |
| 6 2 2 | 2.09 | 0.81-5.37 |
| 6 2 1 | 1.84 | 0.72-4.73 |
| 6 2 0 | 1.60 | 0.62-4.11 |
| 6 1 2 | 1.82 | 0.71-4.68 |
| 6 1 1 | 1.58 | 0.61-4.06 |
| 6 1 0 | 1.35 | 0.53-3.47 |
| 6 0 2 | 1.56 | 0.61-4.01 |
| 6 0 1 | 1.34 | 0.52-3.44 |
| 6 0 0 | 1.13 | 0.44-2.90 |
| 5 5 1 | 2.07 | 0.81-5.32 |
| 5 5 0 | 1.85 | 0.72-4.75 |
| 5 4 1 | 1.84 | 0.72-4.73 |
| 5 4 0 | 1.63 | 0.63-4.19 |
| 5 3 2 | 1.82 | 0.71-4.68 |
| 5 3 1 | 1.61 | 0.63-4.14 |
| 5 3 0 | 1.41 | 0.55-3.62 |
| 5 2 2 | 1.60 | 0.62-4.11 |
| 5 2 1 | 1.40 | 0.54-3.60 |
| 5 2 0 | 1.21 | 0.47-3.11 |
| 5 1 2 | 1.39 | 0.54-3.57 |
| 5 1 1 | 1.20 | 0.47-3.08 |
| 5 1 0 | 1.01 | 0.39-2.60 |
| 5 0 2 | 1.19 | 0.46-3.06 |
| 5 0 1 | 1.01 | 0.39-2.60 |
| 5 0 0 | 0.83 | 0.32-2.13 |
| 4 4 0 | 1.28 | 0.50-3.29 |
| 4 3 1 | 1.27 | 0.49-3.26 |
| 4 3 0 | 1.10 | 0.43-2.83 |
| 4 2 1 | 1.09 | 0.42-2.80 |
| 4 2 0 | 0.93 | 0.36-2.39 |
| 4 1 2 | 1.08 | 0.42-2.78 |
| 4 1 1 | 0.92 | 0.36-2.36 |
| 4 1 0 | 0.76 | 0.30-1.95 |
| 4 0 2 | 0.91 | 0.35-2.34 |
| 4 0 1 | 0.75 | 0.29-1.93 |
| 4 0 0 | 0.60 | 0.23-1.54 |
| 3 4 0 | 1.01 | 0.39-2.60 |
| 3 3 1 | 1.00 | 0.39-2.57 |
| 3 3 0 | 0.85 | 0.33-2.18 |
| 3 2 1 | 0.85 | 0.33-2.18 |
| 3 2 0 | 0.70 | 0.27-1.80 |
| 3 1 2 | 0.84 | 0.33-2.16 |
| 3 1 1 | 0.70 | 0.27-1.80 |
| 3 1 0 | 0.56 | 0.22-1.44 |
| 3 0 2 | 0.69 | 0.27-1.77 |
| 3 0 1 | 0.55 | 0.21-1.41 |
| 3 0 0 | 0.41 | 0.16-1.05 |
| 2 4 0 | 0.79 | 0.31-2.03 |
| 2 3 1 | 0.79 | 0.31-2.03 |
| 2 3 0 | 0.66 | 0.26-1.70 |
| 2 2 1 | 0.65 | 0.25-1.67 |
| 2 2 0 | 0.52 | 0.20-1.34 |
| 2 1 1 | 0.52 | 0.20-1.34 |
| 2 1 0 | 0.39 | 0.15-1.00 |
| 2 0 2 | 0.51 | 0.20-1.31 |
| 2 0 1 | 0.38 | 0.15-0.98 |
| 2 0 0 | 0.26 | 0.10-0.67 |
| 1 3 0 | 0.49 | 0.19-1.26 |
| 1 2 1 | 0.49 | 0.19-1.26 |
| 1 2 0 | 0.36 | 0.14-0.93 |
| 1 1 1 | 0.36 | 0.14-0.93 |
| 1 1 0 | 0.24 | 0.09-0.62 |
| 1 0 2 | 0.36 | 0.14-0.93 |
| 1 0 1 | 0.24 | 0.09-0.62 |
| 1 0 0 | 0.12 | 0.05-0.31 |
| 0 2 0 | 0.23 | 0.09-0.59 |
| 0 1 1 | 0.23 | 0.09-0.59 |
| 0 1 0 | 0.11 | 0.04-0.28 |
| 0 0 1 | 0.11 | 0.04-0.28 |

Table 10: Protection in Mice.

The table shows the level of protection achieved after immunisation with *Borrelia* antigens against a challenge with *B. burgdorferi* s.s. strain N40. *Borrelia* infection of mice was determined with Western blot (WB) of post-challenge sera and cultivation of *Borrelia* from ear and bladder (C). The percentages of uninfected mice are listed in the table for the test antigens and the control groups in the respective animal experiment. nd: not determined.

TABLE 10

| | | | % Noninfected mice | | | | | |
|---|---|---|---|---|---|---|---|---|
| | | | Test Protein | | PBS | | OspA | |
| Animal Experiment | Challenge Dose | Protein Construct | WB | C | WB | C | WB | C |
| 1 | nd | Bbu0210-1 | 50% | 50% | 20% | 20% | 100% | 100% |
| | | Bbu0210-2 | 40% | 40% | | | | |
| | | Baf0221 | 40% | 40% | | | | |
| | | Baf0237 | 30% | 30% | | | | |
| | | Baf0512-2 | 30% | 30% | | | | |
| | | Baf0627 | 30% | 30% | | | | |
| | | Bbu0680-2 | 30% | 30% | | | | |
| | | BbuA0034-1 | 60% | 60% | | | | |
| 2 | 18900 | BB0058-1 | nd | 10% | 0% | 0% | 70% | 70% |
| | | Baf0581 | nd | 10% | | | | |
| 3 | 16300 | BB0794-3 | nd | 10% | nd | 0% | nd | 60% |

EXAMPLES

Example 1

General Screening Procedure for the Identification of the Peptides According to the Present Invention The approach, which has been employed for the present invention, is based on the interaction of proteins or peptides encoded by *B. burgdorferi* s.l. with the antibodies present in human sera. The antibodies produced against *B. burgdorferi* s.l. by the human immune system and present in human sera are indicative of the in vivo expression of the antigenic proteins and their immunogenicity. In addition, the antigenic proteins as identified by the bacterial surface display expression libraries using pools of pre-selected sera, are processed in a second and third round of screening by individual selected or generated sera. Thus the present invention supplies an efficient, relevant, comprehensive set of antigens as a pharmaceutical composition, especially a vaccine preventing infections caused by *B. burgdorferi* s.l.

In the antigen identification program for identifying a comprehensive set of antigens according to the present invention, at least two different bacterial surface display expression libraries from *B. burgdorferi* s.l. are screened with several serum pools or plasma fractions or other pooled antibody containing body fluids (antibody pools). The antibody pools are derived from a serum collection, which has been tested against antigenic compounds of *B. burgdorferi* s.l., such as whole cell, total extracts. Preferably, six pools of sera (with 25 individual samples) are used. Sera determined to have high ELISA titre have to react with multiple proteins in immunoblotting in order to be considered hyperimmune and therefore relevant in the screening method applied for the present invention.

The expression libraries as used in the present invention should allow expression of all potential antigens, e.g. derived from all secreted and surface proteins of *B. burgdorferi* s.l. Bacterial surface display libraries will be represented by a recombinant library of a bacterial host displaying a (total) set of expressed peptide sequences of *B. burgdorferi* s.l. on two selected outer membrane proteins (LamB and FhuA) at the bacterial host membrane (Georgiou, G., 1997; Etz, H. et al., 2001). One of the advantages of using recombinant expression libraries is that the identified hyperimmune serum-reactive antigens may be instantly produced by expression of the coding sequences of the screened and selected clones expressing the hyperimmune serum-reactive antigens without further recombinant DNA technology or cloning steps necessary.

The comprehensive set of antigens identified by the described program according to the present invention is analysed further by one or more additional rounds of screening. Therefore individual antibody preparations or antibodies generated against selected peptides, which were identified as immunogenic are used. According to a preferred embodiment the individual antibody preparations for the second round of screening are derived from healthy adults and/or challenged adults who show an antibody titre above a certain minimum level, for example an antibody titre being higher than 80 percentile, preferably higher than 90 percentile, especially higher than 95 percentile of the human (patient or healthy individual) sera tested. Using such high titre individual antibody preparations in the second screening round allows a very selective identification of the hyperimmune serum-reactive antigens and fragments thereof from *B. burgdorferi* s.l.

Following the comprehensive screening procedure, the selected antigenic proteins, expressed as recombinant proteins or in vitro translated products, in case it can not be expressed in prokaryotic expression systems, or the identified antigenic peptides (produced synthetically) are tested in a second screening by a series of ELISA and Western blotting assays for the assessment of their immunogenicity with a large human serum collection (minimum ~20 healthy and patients sera).

It is important that the individual antibody preparations (which may also be the selected serum) allow a selective identification of the most promising candidates of all the hyperimmune serum-reactive antigens from all the promising candidates from the first round. Therefore, preferably at least 10 individual antibody preparations (i.e. antibody preparations (e.g. sera) from at least 10 different individuals suffered from an infection to the chosen pathogen) should be used in identifying these antigens in the second screening round. Of course, it is possible to use also less than 10 individual preparations, however, selectivity of the step may not be optimal with a low number of individual antibody preparations. On the other hand, if a given hyperimmune serum-reactive antigen (or an antigenic fragment thereof) is recognized by at least 10 individual antibody preparations, preferably at least 30, especially at least 50 individual antibody preparations, identification of the hyperimmune serum-reactive antigen is also selective enough for a proper identification. Hyperimmune serum-reactivity may of course be tested with as many individual preparations as possible (e.g. with more than 100 or even with more than 1,000).

Therefore, the relevant portion of the hyperimmune serum-reactive antibody preparations according to the method of the present invention should preferably be at least 10, more preferred at least 30, especially at least 50 individual antibody preparations. Alternatively (or in combination) hyperimmune serum-reactive antigens may preferably be also identified with at least 20%, preferably at least 30%, especially at least 40% of all individual antibody preparations used in the second screening round.

According to a preferred embodiment of the present invention, the sera from which the individual antibody preparations for the second round of screening are prepared (or which are used as antibody preparations), are selected by their titre against *B. burgdorferi* s.l. (e.g. against a preparation of these pathogens, such as a lysate, cell wall components and recombinant proteins). Preferably, some are selected with an IgG titre above 1,000 U, especially above 5,000 U (U=units, calculated from the OD405 nm reading at a given dilution) when the whole organism (total lysate or whole cells) is used as antigen in the ELISA.

The antibodies produced against *B. burgdorferi* s.l. by the human immune system and present in human sera are indicative of the in vivo expression of the antigenic proteins and their immunogenicity. The recognition of linear epitopes recognized by serum antibodies can be based on sequences as short as 4-5 amino acids. Of course it does not necessarily mean that these short peptides are capable of inducing the given antibody in vivo. For that reason the defined epitopes, polypeptides and proteins are further to be tested in animals (mainly in mice) for their capacity to induce antibodies against the selected proteins in vivo.

The preferred antigens are located on the cell surface or secreted, and are therefore accessible extracellularly. Antibodies against cell wall proteins are expected to serve multiple purposes: to inhibit adhesion, to interfere with nutrient acquisition, to inhibit immune evasion and to promote phagocytosis (Hornef, M. et al., 2002). Antibodies against secreted proteins are beneficial in neutralisation of their function as toxin or virulence component. It is also known that bacteria communicate with each other through secreted proteins. Neutralizing antibodies against these proteins will interrupt growth-promoting cross-talk between or within infection causing pathogen species. Bioinformatic analyses (signal sequences, cell wall localisation signals, transmembrane domains) proved to be very useful in assessing cell surface localisation or secretion. The experimental approach includes the isolation of antibodies with the corresponding epitopes and proteins from human serum, and the generation of immune sera in mice against (poly) peptides selected by the bacterial surface display screens. These sera are then used in a third round of screening as reagents in at least one of the following assays: cell surface staining of B. burgdorferi s.l. grown under different conditions (FACS or microscopy), determination of neutralizing capacity (toxin, adherence), and promotion of opsonization and phagocytosis (in vitro phagocytosis assay).

For that purpose, bacterial E. coli clones are directly injected into mice and immune sera are taken and tested in the relevant in vitro assay for functional opsonic or neutralizing antibodies. Alternatively, specific antibodies may be purified from human or mouse sera using peptides or proteins as substrate.

According to the antigen identification method used herein, the present invention can surprisingly provide a set of comprehensive novel nucleic acids and novel proteins, antigens and more specifically hyperimmune serum reactive antigens and fragments thereof of B. burgdorferi s.l., among other things, as described herein. The nucleotide sequences according to the present invention encoding hyperimmune serum reactive antigens have a nucleotide sequence which is individually set forth in Seq ID Nos 1-134, 269-387 and 507-628, whereby the corresponding encoded amino acid sequences have an amino acid sequence as set forth in Seq ID Nos 135-268, 388-506 and 629-750.

All linear hyperimmune serum reactive fragments of a particular antigen may be identified by analysing the entire sequence of the protein antigen by a set of peptides overlapping by 1 amino acid with a length of at least 10 amino acids. Subsequently, non-linear epitopes can be identified by analysis of the protein antigen with hyperimmune sera using the expressed full-length protein or domain polypeptides thereof. Assuming that a distinct domain of a protein is sufficient to form the 3D structure independent from the native protein, the analysis of the respective recombinant or synthetically produced domain polypeptide with hyperimmune serum would allow the identification of conformational epitopes within the individual domains of multi-domain proteins. For those antigens where a domain possesses linear as well as conformational epitopes, competition experiments with peptides corresponding to the linear epitopes may be used to confirm the presence of conformational epitopes.

Example 2

Characterization and Selection of Human Serum Sources Based on Anti-B. burgdorferi s.l Antibodies, Preparation of Antibody Screening Reagents Experimental Procedures
Enzyme-Linked Immunosorbent Assay (ELISA).

ELISA plates (Maxisorb, Millipore) were coated with 5-10 μg/ml total protein diluted in coating buffer (0.1 M sodium carbonate pH 9.2). For whole cell ELISA, $10^6$ biotin-labelled and fixed bacteria were added to Streptavidin-coated ELISA plates. Two dilutions of sera (10,000×, 50,000×) were made in PBS-BSA. Highly specific Horse Radish Peroxidase (HRP)-conjugated anti-human IgG secondary antibodies (Southern Biotech) were used according to the manufacturer's recommendations (dilution: 1,000×). Antigen-antibody complexes were quantified by measuring the conversion of the substrate (ABTS) to coloured product based on $OD_{405nm}$ readings by automatic ELISA reader (TECAN SUNRISE).
Preparation of Bacterial Antigen Extracts.

Total bacterial lysate: The B. burgdorferi s.s. strain B31 and B. afzelii strain VS461 were grown for 1 week in BSI-II medium (37° C., 5% $CO_2$) and collected by centrifugation (3,000 rpm, 10 min, 4° C.). Cells were washed twice with PBS, and after re-suspension sonicated for 2 min, pulse 5, 100% power on ice. The supernatant was collected by centrifugation (3,500 rpm, 15 min, 4° C.). Protein concentration was measured with the Bradford assay using protein assay dye reagent concentrate (Bio-Rad Laboratories, Austria).
Immunoblotting Total bacterial lysates were prepared from in vitro grown B. burgdorferi s.s. strain B31 and B. afzelii strain VS461. 10 to 25 μg total protein/lane was separated by SDS-PAGE using the BioRad Mini-Protean Cell electrophoresis system and proteins transferred to nitrocellulose membrane (ECL, Amersham Pharmacia). After overnight blocking in 5% milk, human sera were added at 2,000× dilution, and HRP labelled anti-human IgG was used for detection.
Purification of Antibodies for Genomic Screening Five sera per antibody pool were selected based on the overall anti-bacterial titers for serum used in the screening procedure. Antibodies against E. coli DH5alpha proteins were removed by incubating the heat-inactivated sera with whole cell E. coli DH5alpha cells (transformed with pHIE11, grown under the same condition as used for bacterial surface display). Highly enriched preparations of IgGs from the pooled, depleted sera were generated by protein G affinity chromatography, according to the manufacturer's instructions (UltraLink Immobilized Protein G, Pierce). The efficiency of depletion and purification was checked by ELISA measurements.
Results The antibodies produced against B. burgdorferi s.l. by the human immune system and present in human sera are indicative of the in vivo expression of the antigenic proteins and their immunogenicity. These molecules are essential for the identification of individual antigens in the approach as described in the present invention, which is based on the interaction of the specific anti-bacterial antibodies and the corresponding B. burgdorferi s.l. peptides or proteins. To gain access to relevant antibody repertoires, human sera were collected from individuals with different Lyme borreliosis symptoms and healthy exposed people. It is important to screen with antibodies from Lyme borreliosis patient with different disease manifestations, since the different B. burgdorferi s.l. genospecies causing Lyme borreliosis give rise to different disease symptoms. A distinct set of sera with 1325 samples was collected from Lyme borreliosis patients in Austria and the Czech Republic.

1325 serum samples were collected and characterized for anti-B. burgdorferi s.l. antibodies by a series of immune assays. Primary characterization was done by ELISA using total bacterial lysate for B. burgdorferi s.s. and B. garinii. Antibody titers were measured and ELISA units calculated from serum dilutions in the linear range of response. Sera were ranked based on the antibody reactivity and the highest ones were selected for further testing by immunoblotting. This analysis confirmed a high antibody reactivity of the pre-selected sera against multiple B. burgdorferi s.l. proteins. The reactivities of the sera used for screening against bacterial lysates from *B. burgdorferi* s.s. are shown in FIG. 1A. The final selection of sera to be included in antibody-pools was based mainly on the presence of multiple immunogenic bands in immunoblotting experiments, representative Western blots are shown in FIGS. 1B and C. This extensive antibody characterization approach has led to the unambiguous identification of anti-*B. burgdorferi* s.l. hyperimmune sera.

Selected sera were included in 6 different IgG pools (3-5 sera in each pool) for antigen identification by bacterial surface display. IgG antibodies were purified from pooled sera by affinity chromatography and depleted of *E. coli* DH5alpha-reactive antibodies to avoid background in the bacterial surface display screens. The serum pools are representing Erythema migrans EM-IgG (P3055, P3144, P3186 and P3219), Neuroborreliosis NB-IgG (P3077, P3084, P3286, P3288 and P3337), Acrodermitis Chronica Atrophicans ACA-IgG (P3183, P3209 and P3336), Lyme arthritis LA-IgG (P3120, P3239 and P3251) and two pools generated with sera from patients with mixed symptoms LBI-IgG (P1755, P1766, P1772, P1806 and P1811) and LBII-IgG (P3016, P3150, P3301, P3344 and P3394).

Example 3

Generation of Highly Random, Frame-Selected, Small-Fragment, Genomic DNA Libraries of *B. Burgdorferi* s.l.

Experimental Procedures

Preparation of Genomic DNA.

Cells from a 400 ml bacterial culture were harvested (5,000 rpm, 20 min, room temperature), washed with 80 ml 50 mM Tris pH 7.4 and re-suspended in 10 ml 50 mM Tris pH 7.4/25% Sucrose/50 mM EDTA. The suspension was transferred to a fresh glass tube and Lysozyme (final conc.: 1.5 mg/ml) and SDS (final conc.: 2%) were added. The tube was incubated on ice for cell lysis. Proteinase K (final conc.: 0.1 mg/ml) was added and incubated for 10 min at 37° C., followed by Phenol/Chloroform (1:1) extraction, which was performed several times. A final extraction step was performed with Chloroform/Isoamylalcohol (1:24) to remove Phenol traces. The sample was treated with RNase A (final conc.: 10 μg/ml) for 1 h at room temperature and Phenol/Chloroform and Chloroform/Isoamylalcohol extractions were performed as described above. DNA in the remaining supernatant was precipitated by addition of 1/10th of the starting volume of 3 M NaAc (pH 5.3) and 2.5× of the volume of 99.5% Ethanol. After 1 h incubation at −20° C., the mixture was centrifuged (20,000 rpm, 15 min) and the pellet washed with 70% Ethanol. Finally, the pellet was dissolved in TE-Buffer.

Preparation of Small Genomic DNA Fragments.

Genomic DNA fragments were mechanically sheared into fragments ranging in size between 150 and 300 bp using a cup-horn sonicator (Bandelin Sonoplus UV 2200 sonicator equipped with a BB5 cup horn, 10 sec. pulses at 100% power output) or into fragments of size between 50 and 70 bp mild DNase I treatment (Novagen). It was observed that sonication yielded a much tighter fragment size distribution when breaking the DNA into fragments of the 150-300 bp size range. However, despite extensive exposure of the DNA to ultrasonic wave-induced hydromechanical shearing force, subsequent decrease in fragment size could not be efficiently and reproducibly achieved. Therefore, fragments of 50 to 70 bp in size were obtained by mild DNase I treatment using Novagen's shotgun cleavage kit. A 1:20 dilution of DNase I provided with the kit was prepared and the digestion was performed in the presence of $MnCl_2$ in a 60 μl volume at 20° C. for 5 min to ensure double-stranded cleavage by the enzyme. Reactions were stopped with 2 μl of 0.5 M EDTA and the fragmentation efficiency was evaluated on a 2% TAE-agarose gel. This treatment resulted in total fragmentation of genomic DNA into near 50-70 bp fragments. Fragments were then blunt-ended twice using T4 DNA Polymerase in the presence of 100 μM each of dNTPs to ensure efficient flushing of the ends. Fragments were used immediately in ligation reactions or frozen at −20° C. for subsequent use.

Description of the Vectors.

The vector pMAL4.31 was constructed on a pASK-IBA backbone (Skerra, A., 1994) with the beta-lactamase (bla) gene exchanged with the Kanamycin resistance gene. In addition the bla gene was cloned into the multiple cloning site. The sequence encoding mature beta-lactamase is preceded by the leader peptide sequence of ompA to allow efficient secretion across the cytoplasmic membrane. Furthermore a sequence encoding the first 12 amino acids (spacer sequence) of mature beta-lactamase follows the ompA leader peptide sequence to avoid fusion of sequences immediately after the leader peptidase cleavage site, since e.g. clusters of positive charged amino acids in this region would decrease or abolish translocation across the cytoplasmic membrane (Kajava, A. et al., 2000). A SmaI restriction site serves for library insertion. An upstream FseI site and a downstream NotI site, which were used for recovery of the selected fragment, flank the SmaI site. The three restriction sites are inserted after the sequence encoding the 12 amino acid spacer sequence in such a way that the bla gene is transcribed in the −1 reading frame resulting in a stop codon 15 bp after the NotI site. A +1 bp insertion restores the bla ORF so that beta-lactamase protein is produced with a consequent gain of Ampicillin resistance.

The vector pMAL9.1 was constructed by cloning the lamB gene into the multiple cloning site of pEH1 (Hashemzadeh-Bonehi, L. et al., 1998). Subsequently, a sequence was inserted in lamB after amino acid 154, containing the restriction sites FseI, SmaI and NotI. The reading frame for this insertion was constructed in such a way that transfer of frame-selected DNA fragments excised by digestion with FseI and NotI from plasmid pMAL4.31 yields a continuous reading frame of lamB and the respective insert.

The vector pHIE11 was constructed by cloning the fhuA gene into the multiple cloning site of pEH1. Thereafter, a sequence was inserted in fhuA after amino acid 405, containing the restriction site FseI, XbaI and NotI. The reading frame for this insertion was chosen in a way that transfer of frame-selected DNA fragments excised by digestion with FseI and NotI from plasmid pMAL4.31 yields a continuous reading frame of fhuA and the respective insert.

Cloning and Evaluation of the Library for Frame Selection.

Genomic *B. burgdorferi* s.l. DNA fragments were ligated into the SmaI site of the vector pMAL4.31. Recombinant DNA was electroporated into DH10B electrocompetent *E. coli* cells (GIBCO BRL) and transformants plated on LB-agar supplemented with Kanamycin (50 μg/ml) and Ampicillin (50 μg/ml). Plates were incubated over night at 37° C. and colonies collected for large scale DNA extraction. A representative plate was stored and saved for collecting colonies for colony PCR analysis and large-scale sequencing. A simple colony PCR assay was used to initially determine the rough fragment size distribution as well as insertion efficiency. From sequencing data the precise fragment size was evaluated, junction intactness at the insertion site as well as the frame selection accuracy (3n+1 rule).

Cloning and Evaluation of the Library for Bacterial Surface Display.

Genomic DNA fragments were excised from the pMAL4.31 vector, containing the *B. burgdorferi* s.l. library with the restriction enzymes FseI and NodI. The entire population of fragments was then transferred into plasmids pMAL9.1 (LamB) or pHIE11 (FhuA), which have been digested with FseI and NotI. Using these two restriction enzymes, which recognise an 8 bp GC rich sequence, the reading frame that was selected in the pMAL4.31 vector is maintained in each of the platform vectors. The plasmid library was then transformed into *E. coli* DH5alpha cells by electroporation. Cells were plated onto large LB-agar plates supplemented with 50 µg/ml Kanamycin and grown over night at 37° C. at a density yielding clearly visible single colonies. Cells were then scraped off the surface of these plates, washed with fresh LB medium and stored in aliquots for library screening at −80° C.

Results

Libraries for Frame Selection.

Two libraries were generated for *B. afzelii* strain K78 in the pMAL4.31 vector with sizes of approximately 70 and 300 bp, respectively. For each library, ligation and subsequent transformation of approximately 1 μg of pMAL4.31 plasmid DNA and 50 ng of fragmented genomic *B. afzelii* DNA yielded $8\times10^4$ to $2\times10^5$ clones after frame selection. To assess the randomness of the libraries, approximately 500 to 600 randomly chosen clones of each library were sequenced. The representative bioinformatic analysis of two libraries (LBA-50 and LBA-300) showed that of clones corresponding to these libraries only very few were present more than once. Furthermore, it was shown for the LBA-50 library that the average insert size was 51 bp, very close to the expected insert size (FIG. 2A). Regarding the LBA-300 library, the average insert size was 170 bp slightly shorter than the expected insert size (FIG. 2B).

Bacterial Surface Display Libraries.

The display of peptides on the surface of *E. coli* required the transfer of the inserts from the LBA-50 and the LBA-300 libraries from the frame selection vector pMAL4.31 to the display plasmids pMAL9.1 (LamB) or pHIE11 (FhuA). Genomic DNA fragments were excised by FseI and NotI restriction and ligation of 5 ng inserts with 0.1 μg plasmid DNA and subsequent transformation into DH5alpha cells resulted in $2\times10^5$ to $5\times10^5$ clones. The clones were scraped off the LB plates and frozen without further amplification.

Example 4

Identification of Highly Immunogenic Peptide Sequences from *B. burgdorferi* s.l. Using Bacterial Surface Displayed Genomic Libraries and Human Serum Experimental Procedures MACS Screening.

Approximately $2.5\times10^8$ cells from a given library were grown in 5 ml LB-medium supplemented with 50 μg/ml Kanamycin for 2 h at 37° C. Expression was induced by the addition of 1 mM IPTG for 30 min. Cells were washed twice with fresh LB medium and approximately $2\times10^7$ cells re-suspended in 100 μl LB medium and transferred to an Eppendorf tube.

10 to 20 μg of biotinylated, human IgGs purified from serum was added to the cells and the suspension incubated overnight at 4° C. with gentle shaking. 900 μl of LB medium was added, the suspension mixed and subsequently centrifuged for 10 min at 6,000 rpm at 4° C. Cells were washed once with 1 ml LB and then re-suspended in 100 μl LB medium. 10 μl of MACS microbeads coupled to streptavidin (Miltenyi Biotech, Germany) were added and the incubation continued for 20 min at 4° C. Thereafter 900 μl of LB medium was added and the MACS microbead cell suspension was loaded onto the equilibrated MS column (Miltenyi Biotech, Germany) which was fixed to the magnet. (The MS columns were equilibrated by washing once with 1 ml 70% EtOH and twice with 2 ml LB medium.)

The column was then washed three times with 3 ml LB medium. After removal of the magnet, cells were eluted by washing with 2 ml LB medium. After washing the column with 3 ml LB medium, the 2 ml eluate was loaded a second time on the same column and the washing and elution process repeated. The loading, washing and elution process was performed a third time, resulting in a final eluate of 2 ml.

Cells selected after two rounds of selection were plated onto LB-agar plates supplemented with 50 μg/ml Kanamycin and grown over night at 37° C.

Evaluation of Selected Clones by Sequencing and Western Blot Analysis.

Randomly selected clones were grown overnight at 37° C. in 3 ml LB medium supplemented with 50 μg/ml Kanamycin to prepare plasmid DNA using standard procedures. Sequencing was performed at MWG (Germany).

For Western blot analysis approximately 10 to 20 μg of total cellular protein was separated by 10% SDS-PAGE and blotted onto HybondC membrane (Amersham Pharmacia Biotech, England). The LamB or FhuA fusion proteins were detected using human serum as the primary antibody at a dilution of approximately 1:3,000 to 1:5,000 and anti-human IgG antibodies coupled to HRP at a dilution of 1:5,000 as secondary antibodies. Detection was performed using the ECL detection kit (Amersham Pharmacia Biotech, England). Alternatively, rabbit anti-FhuA or rabbit anti-LamB polyclonal immune sera were used as primary antibodies in combination with the respective secondary antibodies coupled to HRP for the detection of the fusion proteins.

Results

Screening of Bacterial Surface Display Libraries by Magnetic Activated Cell Sorting (MACS) Using Biotinylated Igs.

The libraries K78-LamB in pMAL9.1 and K78-FhuA in pHIE11 were screened with pools of biotinylated, human IgGs prepared from sera of Lyme borreliosis patients (P1755, P1766, P1772, P1806, P1811, P3055, P3144, P3186, P3219, P3077, P3084, P3286, P3288, P3337, P3016, P3150, P3301, P3344, P3394, P3183, P3209, P3336, P3120, P3239, P3251) (see Example 1: Preparation of Antibodies from Human Serum). The Selection Procedure was Performed as described under Experimental procedures. FIG. 3A shows a representative example of a screen with the K78-FhuA library and EM-IgGs. As can be seen from the colony count after the first selection cycle from MACS screening, the total number of cells recovered at the end is drastically reduced from $1\times10^7$ cells to approximately $3\times10^4$ cells, and the selection without antibodies showed a more pronounced reduction in cell numbers, showing that selection was dependent on *B. burgdorferi* s.l. specific antibodies (FIG. 3A). To evaluate the performance of the screen, 20 selected clones were picked randomly and subjected to immunoblot analysis with the screening EM-IgG pool (FIG. 3B). This analysis revealed that a majority of selected clones showed reactivity with antibodies present in the relevant serum whereas the control strain expressing FhuA without a *B. afzelii* specific insert did not react with the same serum. In general, the rate of reactivity was observed to lie within the range of 40 to 70%. Colony PCR analysis showed that all selected clones contained an insert in the expected size range.

Figure 3A:
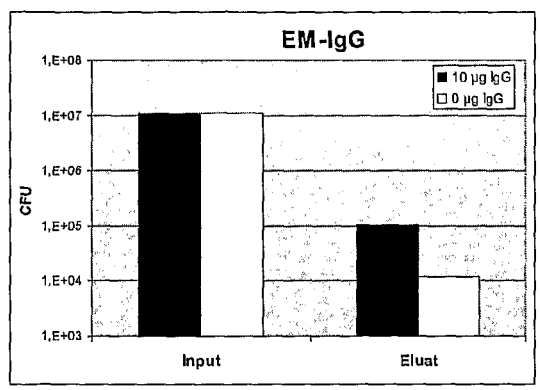
FIG. 3 shows the selection of bacterial cells by MACS using biotinylated human IgGs.
Figure 3B:
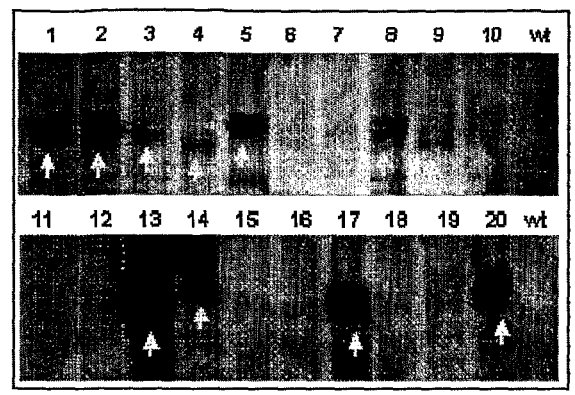
Figure 3C:
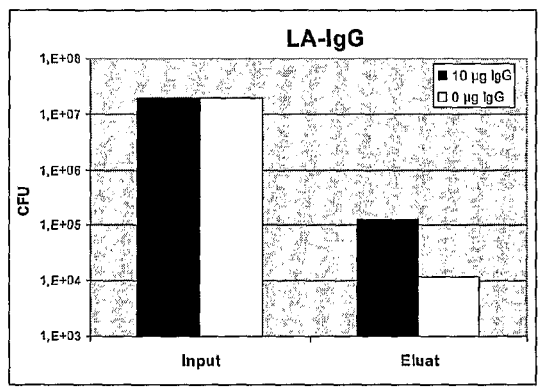
Figure 3D:
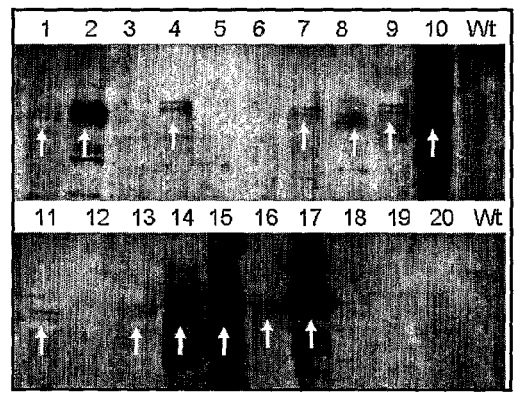

Similar results were seen in screens with libraries from the other serum pools. As a second example, FIGS. 3C and D show the data obtained with the large insert K78-FhuA and the LA-IgG antibody pool. One round of MACS selection resulted in the enrichment of cells only in the presence, but not the absence of specific IgG (FIG. 3C), indicating that the selection was specific for the applied antibodies. The specific selection was then confirmed in the Western blot analysis of individual bacterial clones with the same LA-IgG antibody pool (FIG. 3D).

Subsequent sequencing of a larger number of randomly picked clones (600 to 800) from each screen led to the identification of the gene and the corresponding peptide or protein sequence that was specifically recognized by the human serum antibodies used for screening. The frequency with which a specific clone is selected reflects at least in part the abundance and/or affinity of the specific antibodies in the serum used for selection and recognizing the epitope presented by this clone. In that regard it is striking that clones derived from some ORFs (e.g. BAP001 and BAP024) were picked more than 100 times, indicating their highly immunogenic property. Table 1 summarizes the data obtained for all 12 performed screens. All clones that are presented in Table 1 have been verified by immunoblot analysis using whole cellular extracts from single clones to show the indicated reactivity with the pool of human serum used in the respective screen. As can be seen from Table 1, distinct regions of the identified ORF are identified as immunogenic, since variably sized fragments of the proteins are displayed on the surface by the platform proteins. Since the genomic sequence of *B. afzelii* was not available at the time of the performance of the screens, all BLAST analyses with epitopes derived from the *B. afzelii* screens, have been first performed with the genomic sequence from *B. burgdorferi* s.s. and later with the genomic sequence from *B. garinii*. Table 1 displays the *B. afzelii* ORF names derived from a preliminary annotation of the *B. afzelii* K78 genome, plasmid derived ORFs are chronologically numbered.

It is further worth noticing that many of the genes identified by the bacterial surface display screens encode proteins that are attached to the surface of the bacterium. This is in accordance with the expected role of surface attached proteins in virulence of *B. burgdorferi* s.l.

Example 5

Gene Distribution Studies with Highly Immunogenic Proteins Identified from *B. afzelii* K78

Experimental Procedures
Gene Distribution of Antigens by PCR.

An ideal vaccine antigen would be an antigen that is present in all, or the vast majority of strains of the target organism to which the vaccine is directed. In order to establish whether the genes encoding the identified *B. afzelii* K78 antigens occur ubiquitously in the relevant strains, PCR was performed on a series of independent bacterial isolates with primers specific for the gene of interest. *B. burgdorferi* s.l. isolates were obtained covering the ospC types most frequently present in patients as shown in Table 3. Oligonucleotide sequences as primers were designed for all identified ORFs yielding products of approximately 1,000 bp, if possible covering all identified immunogenic epitopes. Genomic DNA of all *B. burgdorferi* s.l. strains was prepared as described under Example 2. PCR was performed in a reaction volume of 25 µl using Taq polymerase (1 U), 200 nM dNTPs, 10 pMol of each oligonucleotide and the kit according to the manufacturer's instructions (Invitrogen, The Netherlands). As standard, 30 cycles (1×: 5 min. 95° C., 30×: 30 sec. 95° C., 30 sec. 56° C., 30 sec. 72° C., 1×4 min. 72° C.) were performed, unless conditions had to be adapted for individual primer pairs.

Results

Identified genes encoding immunogenic proteins were tested by PCR for their presence in 30 different *B. burgdorferi* s.l. strains (Table 3). As an example, FIG. 4 shows the PCR reaction for the *B. afzelii* BAP004 antigen with all indicated 30 strains. As clearly visible, the gene is present in all strains analysed. All results with the selected antigens are summarized in Table 4. Importantly, some of the identified antigens are well conserved in all strains of the respective pathogen in sequence and size and are therefore novel vaccine candidates to prevent infections by *B. burgdorferi* s.l.

Example 6

Immunogenicity of Immune Sera Obtained from Mice Immunized with Highly Immunogenic Proteins/Peptides from *B. burgdorferi* s.l. Displayed on the Surface of *E. coli*

Experimental Procedures
Generation of Immune Sera from Mice.

*E. coli* clones harbouring plasmids encoding the platform protein fused to a *B. afzelii* K78 peptide, were grown in LB medium supplemented with 50 µg/ml Kanamycin at 37° C. Overnight cultures were diluted 1:10, grown until an $OD_{600}$ of 0.5 and induced with 0.2 mM IPTG for 2 hours. Pelleted bacterial cells were suspended in PBS buffer and disrupted by sonication on ice, generating a crude cell extract. According to the $OD_{600}$ measurement, an aliquot corresponding to $5\times10^7$ cells was injected into NMRI mice i.v., followed by a boost after 2 weeks. Serum was taken 1 week after the second injection. Epitope specific antibody levels were measured by peptide ELISA.

Results
Immunogenicity in Mice.

The presence of specific antibodies was determined by peptide ELISA as it is exemplified in FIG. 5, and summarized in Table 5. Ninety-nine antigens from *B. burgdorferi* s.l. represented by 109 different epitope regions were shown to be immunogenic in mice. These experiments confirmed the bioinformatic prediction that many of the identified epitopes/proteins are immunogenic not only in humans, but also in experimental animals.

Example 7

Validation of Peptides from *B. afzelii* K78 by Peptide ELISA

Enzyme-Linked Immunosorbent Assay (ELISA).

ELISA plates (Maxisorb, Millipore) were coated with 5-10 µg/ml total protein diluted in coating buffer (0.1 M sodium carbonate pH 9.2). Two dilutions of sera (400×, 2,000×) were made in PBS-BSA. Highly specific Horse Radish Peroxidase (HRP)-conjugated anti-human IgG secondary antibodies (Southern Biotech) were used according to the manufacturer's recommendations (dilution: 1,000×). Antigen-antibody complexes were quantified by measuring the conversion of the substrate (ABTS) to coloured product based on $OD_{405nm}$ readings by automatic ELISA reader (TECAN SUNRISE).

The measurements at 400× dilution were used for the calculation of the results as displayed in Table 6.

Results

Immunogenicity in Humans.

The presence of specific antibodies in human sera was determined by peptide ELISA as summarized in Table 6. The human sera used for this analysis correspond to those that were included in the various serum pools applied for the identification of antigens by the bacterial surface display screens. Single or multiple peptides from individual antigens from *B. afzelii* K78 were analysed and many of these were shown to be immunogenic in humans. It is evident that some of the selected peptides are highly reactive with many or all of the investigated human sera (e.g. BAOba0565.02 or BAOba0077.01), while others showed intermediate reactivities. For those antigens for which the selected epitope encompassed more than 30 amino acids, multiple peptides were designed with an overlap of 5 to 6 amino acids. For some of the antigens, it was observed that these multiple peptides from the same antigen showed different reactivities, further delineating the immunogenic region of the respective antigen (e.g. BA0314 or BA0546). These experiments confirmed that many of the identified epitopes/proteins are highly immunogenic in humans, indicating that they are expressed by the pathogen during infection and capable of inducing a strong immune response.

Example 8

Surface Binding to *B. burgdorferi* s.l. of Immune Sera Obtained from Mice Immunized with Highly Immunogenic Proteins/Peptides from *B. afzelii* K78 Displayed on the Surface of *E. coli*

Experimental Procedures

FACS Analysis.

The *B. afzelii* strain K78 was cultivated at 34° C.; the number of spirochetes was determined by dark-field microscopy and spirochetes were diluted with fresh BSK medium to a concentration of $10^6$ organisms per milliliter. Each mouse sera were diluted 1:25 with fresh BSK medium (100 µl) and heat inactivated for 30 min at 56° C. 100 µl of mouse sera is added to 100 µl ($10^5$ cells) of the *Borrelia* suspension (sera finally 1:50 diluted). The assay suspension is gently mixed and incubated at room temperature for 1 hour. After incubation, the samples were centrifuged at 5,000 rpm for 3 min, and washed once with 1 ml PBS, 0.5% BSA. Secondary staining was done with PE conjugated anti-mouse antibody which were used according to the manufacturer's recommendations (diluted in 100 µl). Secondary staining was performed on ice for 45 min. At the end of the incubation, the samples are centrifuged at 5,000 rpm for 3 min, washed with 1 ml PBS 0.5% BSA and resuspended in 1 ml of PBS-1% paraformaldehyde. Samples were vortexed and analysed by flow cytometry.

Results

Surface Binding to *B. Burgdorferi* s.l. Cells.

The presence of antibodies recognising surface proteins on *B. afzelii* K78 were tested in FACS analysis. Thirty-two antigens represented by 40 different sera showed a significant shift in the FACS analysis compared to the buffer control (Table 7). This in vitro experiment indicates that in in vitro cultured *B. burgdorferi* s.l. cells 32 antigens are expressed on the surface.

Example 9

Recombinant *Borrelia* Antigens Induce Protective Immune Response Against a Needle Challenge of *Borrelia burgdorferi* Sensu Stricto Experimental Procedures Cloning and Expression of Recombinant *Borrelia* Proteins Cloning of Genes:

The gene of interest was amplified using specific primers from genomic DNA isolated from the *B. afzelii* K78 by PCR. Apart from the gene specific part, the primers had restriction sites that aided in a directional cloning of the amplified PCR product. The gene annealing (specific) part of the primer ranged between 15-30 bases in length. The PCR products obtained were digested with the appropriate restriction enzymes and cloned into the pET28b (+) vector (Novagen) for His-tagged proteins. The constructs of the selected antigens are listed in Table 8. Once the recombinant plasmid was confirmed to contain the gene of interest, *E. coli* BL21 CodonPlus (DE3)-RIPL cells (Invitrogen) that served as expression host were transformed.

Expression and Purification of Proteins:

*E. coli* BL21 CodonPlus (DE3)-RIPL cells harboring the recombinant plasmid were grown into log phase in the required culture volume. Once an OD600 nm of 0.6 was reached the culture was induced with 0.5 mM IPTG for 3 hours at 37° C. The cells were harvested by centrifugation, lysed by a combination of the freeze-thaw method followed by disruption of cells with Bug-buster® (Novagen). The lysate was separated by centrifugation into soluble (supernatant) and insoluble (pellet) fractions. Depending on the location of the protein different purification strategies were applied:

A) If the His-tagged protein was in the soluble fraction, protein purification was done by binding the supernatant to Ni-Sepharose beads (Ni-Sepharose™ 6 Fast Flow, GE Healthcare). Due to the presence of the hexa Histidine (6×HIS) at the C terminus of the expressed protein, it bound to the Ni-Sepharose while the other contaminating proteins were washed from the column by wash buffer. The protein was eluted by 500 mM Imidazole in 20 mM $NaH_2PO_4$, 0.5 mM NaCl buffer at pH 7.4. The eluate was concentrated, assayed by Bradford for protein concentration and checked by SDS-PAGE and Western blot.

B) If the protein was present in the insoluble fraction the pellet was solubilized in suitable buffer containing 8 M Urea and applied onto the Ni-NTA column under denaturing conditions (in buffer containing 8 M Urea) using the same materials and procedure as mentioned above. Contaminating proteins were washed from the column by wash buffer without urea. Refolding of the His-tagged protein was performed while the protein was immobilized on the Ni-NTA matrix. After renaturation, proteins were eluted by the addition of 500 mM Imidazole. The eluate was dialysed to remove traces of urea and concentrated if the volume was large, checked by SDS-PAGE and measured by the Bradford method.

Animal Protection Studies

Animals:

C3H/HeN female mice (6-8 weeks) were used.

Active Immunisation, Generation of Hyper-Immune Mouse Sera:

50 µg of recombinant proteins were injected subcutaneously into female C3H/HeN mice, with Complete Freund adjuvant (CFA) as adjuvant. Animals were boosted twice with the same amount of protein and Incomplete Freund adjuvant (IFA) at days 14 and 28. The published protective OspA protein antigen was used as a positive control, immunisation with adjuvant alone in PBS buffer served as negative control (PBS). Antibody titres were measured at day 35 by ELISA using the respective recombinant proteins.

Bacterial Challenge:

The *Borrelia burgdorferi* s.s. strain N40 freshly grown in BSK-II medium was used as challenge strain. In order to determine the viable cell numbers present in the bacterial inoculum, a cloning with limited dilution was performed. Eight aliquots of 2 ml BSK-II with theoretically either 10, 1.0 or 0.1 cells/aliquot were incubated at 34° C. and 5% $CO_2$, after three weeks aliquots were evaluated for the presence of live *Borrelia* cells by dark-field microscopy. With the result from the cloning with limited dilution the most probable number of *Borrelia* cells in the first dilution was taken from Table 9. $10^4$ cells were applied subcutaneous into mice. Protection by immunisation was determined by cultivation of *Borrelia* cells from ear and bladder in BSK-II medium and by sero-conversion as determined with Western blot (FIG. 6). Protection was expressed in percentage of the total number of uninfected animals (10 mice/group).

Western Blot:

PAGE 4-20% Tris-glycine ZOOM Gels 1 mm×IPG well (Invitrogen) were used according to the instruction manual. *Borrelia* lysates (25 µg/sample) were mixed with 5× reducing sample buffer and heated for 10 min at 95° C. PageRuler™ prestained protein ladder plus (MW 10-250 kDa; Fermentas, Germany) served as indicator for protein size. Proteins were separated with 160 V for approximately 70 minutes and gels were further used for Western blotting. Proteins separated by one dimensional gel electrophoresis were transferred onto a nitrocellulose membrane (Hybond™ 0.45 Micron, Amersham Bioscience, England) using a semi-dry transfer system (Trans-Blot® SD; BioRad, U.S.A.). Gel and membrane were assembled in a blot sandwich and blotted in Transfer buffer at 80 mA for 1 h at room temperature. Blotted proteins were visualized by Ponceau S (Sigma, Austria) staining. Non-specific binding sites were blocked by incubating membranes in 5% milk-PBS-T for one hour at room temperature. Membranes were washed three times for 15 min with PBS-T solution and subsequently incubated with first antibody solution (individual mouse sera diluted 1:1,000 with 5% milk-PBS-T) for one hour at room temperature. The membranes were washed as described above and subsequently incubated with secondary antibody solution (rabbit anti-mouse IgG-HRP from Jackson Immuno Research Laboratory Inc., U.S.A.; 1:5,000 diluted with 5% milk-PBS-T) for one hour at room temperature. Prior to detection, membranes were washed three times for 15 min with PBS-T. Signals were visualized using an ECL detection kit (Amersham Pharmacia Biotech, England).

Cultivation of *Borrelia* from Mouse Organs:

Organs (ear and bladder) were aseptically taken from the mouse and transferred to tubes with 10 ml BSK-II medium supplemented with 400 µg/ml phosphomycin and 50 µg/ml sulfamethoxazole. The cultures were incubated for a maximum of four weeks at 34° C., 5% $CO_2$. Cultures were examined with dark-field microscopy for the presence of living *Borrelia* cells.

Results

After having established the *Borrelia* animal model with the virulent *B. burgdorferi* s.s. strain N40, the protective capabilities of the in vitro selected vaccine candidates were evaluated. Mice were immunized with recombinant antigens (Table 8) using CFA/IFA as adjuvant before challenging with the *B. burgdorferi* s.s. strain N40. Four weeks after the challenge sera for the determination of sero-conversion by Western blot analyses (FIG. 6) and organs for detection of live *Borrelia* by cultivation in BSK-II medium were taken. The correlation between sero-conversion and cultivation of *Borrelia* from mouse organs was 100%. Several antigens with various levels of protection were identified (Table 10) in the animal studies. The percentage of uninfected mice was compared to the negative control group, mice immunized with adjuvant alone in PBS buffer (PBS). Protective antigens are defined as those where immunisation resulted in at least one more uninfected mouse than in the PBS control group.

The observed protection of the vaccine candidates can be described as cross-protection, because the sequence of the antigens was derived from a *Borrelia burgdorferi* sensu lato genospecies distinct from the challenge strain. The antigens were cloned from the *B. afzelii* strain K78 and the challenge strain used in the animal studies was the *B. burgdorferi* s.s. strain N40. Therefore, higher protection levels would be expected against a challenge strain with the same genospecies, *B. afzelii*, as the origin of the amino acid sequence of the tested vaccine candidates.

REFERENCES

The following references which have been recited in the present specification in a truncated version are incorporated herein by reference in their entirety.

Altschul, S., et al. (1990). *Journal of Molecular Biology* 215: 403-10.
Bennett, D., et al. (1995). *J Mol Recognit* 8: 52-8.
Burgdorfer, W., et al. (1982). *Science* 216: 1317-1319.
Casjens, S., et. al. (2000). *Mol. Mirobiol.* 35: 490-516.
Clackson, T., et al. (1991). *Nature* 352: 624-8.
Current Protocols in Molecular Biology, John Wiley and Sons, Inc. (1987).
Devereux, J., et al. (1984). *Nucleic acids research* 12: 387-95.
Doherty, E., et al. (2001). *Annu Rev Biophys Biomol Struct* 30: 457-475.
Eisenbraun, M., et al. (1993). *DNA Cell Biol* 12: 791-7.
Etz, H., et al. (2001). *J Bacteriol* 183: 6924-35.
Fraser, C., et al. (1997). *Nature* 390: 580-586.
Ganz, T. (1999). *Science* 286: 420-421.
Georgiou, G. (1997). *Nature Biotechnology* 15: 29-34.
Glöckner, G., et al, (2004). *Nucleic acids research* 32: 6038-6046.
Hashemzadeh-Bonehi, L., et al. (1998). *Mol Microbiol* 30: 676-678.
Heinje, von G. (1987). Sequence Analysis in Molecular Biology, Academic Press.
Hemmer, B., et al. (1999). *Nat Med* 5: 1375-82.
Hornet M., et al. (2002). *Nat Immunol* 3: 1033-40.
Johanson, K., et al. (1995). *J Biol Chem* 270: 9459-71.
Jones, P., et al. (1986). *Nature* 321: 522-5.
Kajava, A., et al. (2000). *J Bacteriol* 182: 2163-9.
Kohler, G., et al. (1975). *Nature* 256: 495-7.
Kolaskar, A., et al. (1990). *FEBS Lett* 276: 172-4.
Lewin, A., et al. (2001). *Trends Mol Med* 7: 221-8.
Livey I. et al. (1995). *Mol Microbiol.* 18: 257-69.
Lyme Disease Surveillance (2004). *MMWR* 53: 365-369.
Marks, J., et al. (1992). *Biotechnology* (N Y) 10: 779-83.
McCafferty, J., et al. (1990). *Nature* 348: 552-4.
Norman, R. L. and Kempe, L. L. (1960). J. Biochem. Microbiol. Technol. Engng. 2: 157-163.
Okano, H., et al. (1991). *J Neurochem* 56: 560-7.
Oligodeoxynucleotides as Antisense Inhibitors of Gene Expression; CRC Press, Boca Raton, Fla. (1988).

Rammensee, H., et al. (1999). *Immunogenetics* 50: 213-9.
Report of WHO workshop on Lyme borreliosis and Diagnosis and surveillance (1995). *WHO/CDS/VPH/95* 141.
Seeger, C., et al. (1984). *Proc Natl Acad Sci USA* 81: 5849-52.
Skerra, A. (1994). *Gene* 151: 131-5.
Steere, A. C., et al. (1977). *Arthritis Rheum.* 20: 7-17.
Steere, A. C. (1989). *New England Journal of Medicine* 321: 586-596.
Surveillance of Lyme borreliosis in Germany, 2002 and 2003 (2005). *Euro Surveill.* 10: 83-85.
Tang, D., et al. (1992). *Nature* 356: 152-4.
Tempest, P., et al. (1991). *Biotechnology* (N Y) 9: 266-71.
Tourdot, S., et al. (2000). *Eur J Immunol* 30: 3411-21.
Wilske B. et al. (1988). *Ann N Y Acad Sci.* 539: 126-43.
Xu, Y., et al. (1995). *J. Clin. Microbiol.* 33: 2679-2685.

The features of the present invention disclosed in the specification, the claims and/or the drawings may both separately and in any combination thereof be material for realizing the invention in various forms thereof.

SEQUENCE LISTING (752 sequences)

SEQ ID NO: 1 - DNA, 1968 bp, Borrelia afzelii
atgaaatttaatcgatttttaatgttattcctttttaattttggtgttctgttaggcagtgatactacagcattagggcattatcaaaaggcccatgagtattatttgtctaaaaggtattatgatgctattgatgagcttgttgaggccataaaaattaatcccaattattatgaagcttataaatttattgcatcaatttattattctcttaagatatatactcaagcacaatttttcatagagaaagcttataaaatgtctaacgaagacacggaatataaaattctttatgcgaatatattattaaaaaatgataaaattgatcaagcaaaaaaaatctattctgaggttttagttaaacagagaaacaatattgatgctttggttggacttgcttcaatttttgaaaaaaatggattattcatagctgctgctaattattatttatctattcttgattatagtcaaaataattatagtgcgtttgagcatcttattgatatttatcaaaggttagaaatgcatgacaagattagacatttgataaataaagttagaataaattttttatcttttccagattttcataaaagagtagccgaattttatattagcattaataatttaggacttgctgaaaagtatgctttaaattatttagctttaattgaaagttcttacaaagattttggggttgtcgatgcatatcgattgcttgcgcttgtttatttgcatgaatttaaatatgaggatgcaatagaagcattgcaaaaagctattttagttgataaagagtccgatgagctttattatttattaggttattcttacttgaaatttgggaatgttgaaaaggctattttaaatttagagcgagctaaaaatcttaaaaaagatatagaattttataatattgctcttgaggagagtttttttgcatctaactttagaaattttttaaaaaatgattccaatactaaaatttctaagcattatgaaaatgagggatctaaagcttttaaatctttaaatttaaacaaagcattgtttaatacaaaaaatgctgttgatatttggcctgataatgatagtgccaggtttttgctttcaaaaatatataagctcatgaatttagatattatggcttatgagcagcttttttatttagtaaaacagagaaattctactgattctagaattttggatttttatgatgttgtgtcttttgatgttagaaagtctttattttataaatatggatataaaagtattgctgattttaataaactttacgatgacagaatggtttatagaatggctatttttactcaaagtgagaataagttttttggtgcaaacgatttgatattaagatacgctgaaagggtgcttgagcgtaatttaaatatagaaatagttaactataattttgattacaataaaaataaagattatctgattaataatttttccgaaggattttcttattcaagaaataataatttggatttatttttaatttttgattttaaggcagatattttgaaaaatacagctactttggtagtaaatgttttctcaggaaaaacagggattaaggttggttctttctcttatgatgtgggtggtgttaattatttaagcaatgctttaaattccctttctaaagatttttatgattatttgcccaaaaaaggaaagattcttcaaattaaaaatgacgatactcttattaatcttggtcaagtaaacggtgttgtaaagggtgatatttttttgattctcaaagaaggcgctttaaacagtggtaatagagattctagttttattgtttacaataaaacagatattttgggggagattttaattgaggatgtaagtgattatatttctagaggcgctataaaatcttctacgtttttaaaagattatattcaagagggagcaactgtgattgtaaaaaga

SEQ ID NO: 2 - DNA, 714 bp, Borrelia afzelii
atgaatctaatgttaataactttcaatgaatttaaaacaggaatttcgctcaatgacactagagcagaacatcttgttaaaatcttaaaattaaaagataacgacaaatttaaatttggtattcttggagaaaaaaacatctaccattgcatttataaaaaagataaaaaattatttttcaagaaaatttttaaaataggagaatctaataaacttaaaaaaataaatgtactaattgggatgataaggccaattgttgctaagagaataataaaagaacttgctagcattggaatatacgaaataattttttttaacactgagcttactgaaaaatcatatttaaattctaaaatctttaaaaacaatgattacgaaaaacatttaatagctggagcaatgcaaggaggagtaacatacttcccaaaaataaaaattatggggaatttaaaagacagccttaaatatattaaacaaaaaaattttgaaataaaaatattgcttgaaaaaaatagcaaaaaaaatttaattgacatagaacaaacaaacaatgcaaccattattgtgggacctgagagagggtttacagagaaagaaaaacaattaataacacaatataatttttcctcttatagtatatccccaaacatcctaagaacagaaacagctataattgctgcatctattattactgcatcgaaactaattaatata

SEQ ID NO: 3 - DNA, 945 bp, Borrelia afzelii
atgaaaatattttttgtaagttcttcttctattgctttagaggttttcaaggagattgtaaagcattatgaagtggtgggagttttgaccttgcccgataaccctaaaggtagaggacaaaagttaagtcaaaatgtaataaagttagaagctattgctaagaatattaaagtttttgatcccttgattcttgatgataatatattaaatttaattagggatttgaatccggatttaatgttagttttttcttatggcaagatctttaaaaaagaatttttagatattttcccaaaaggatgtatcaatgttcatccttctcttttgcccaaatatagaggtgtttctcctattcaatctgcaattttaaatggcgattgtgttagcggtattactattcagaatatggctttgaaaatggatagtggaaatattttagtgcagaaaaattttaaaataaaatcttgtgatacaagttatgatatttcaaaacttgtatcaagtcttagtccaaaccttgttttagaagctttggaaaaaattggcaaggggtttttgggaattcctcaaaaatcgagtgaagccactttttgttctttttttaaaaaagaatcgggatttgtagattttaatttaagtgcatttgagattaaaaacagaattaatgcatgcaatccttggccacttgcaagagctaggcttgattatggcgatattatttttcatcgtgctgattttttgaaaatagatttatataaagagaaaaaagtaggagaaattgttgattttgattctgaaaaaggattatttgttaataccggagaagggattcttttgcttttagaagttcaaaggcccggaagaagggttttagattataagtctttttataatgggagcaggcagctaataggacaagtgttttcttcaataggaggggtatat

SEQ ID NO: 4 - DNA, 807 bp, Borrelia afzelii
ttggaaatcgaatttaatatacttgaaaaacagtacaaagatttactcacaatttcttactttaaagaagaacttgacgcaaatgacgcttttttaactattcattctggtgctggaggcactgaagcatgtgactgggttgcaatgctttacagaatgtattcaagatatgcagagagaaaaaaatacaaaacagaacttattgatttgcttgaagcagaaggtggaatcaaatctgttacaatagaaatcaaaggtgaatatgcttatggactgttaaaaagtgaggtcgggatacatcgtcttataagaatttctccgtttgatgctgctaaaaaaagacatacctcttttgcatcggtatttattgaccctgttattgatgaaaaaatagaaataataatcaaaccagaagatataagaattgatacatacagagcatcgggagccggaggacaacatgtcaacaaaacatcttctgctgtaagaataactcacattgaaacaggaatagtcactcaatcccaaagcgaccgaagtcaacacaaaaacaaagatatggcaatgaaagttttaaaatcaagactttacgaatactataagaataaagaagatgaaaaaaacaaatccaagcaagacacaaaaaaagaaatttcttggggcaaccaaataagatcttacgtatttcagccttacaatttggtaaaagatcatagaacaaaatttgaaaattcaaacatcacttcggttatggacggcaatatagataatttcatagaagagtatttaaaatggaaaagcttaaac

SEQ ID NO: 5 - DNA, 1026 bp, Borrelia afzelii
atgaaaaaaaaccaattaatacttcttctatttataccacaaattatttatgcaaaaagctattttgcatccgatgtatttttcaataaataccaaaaattaaacgaaaaaccaaaaacgggattttacattgaatattattttattgatgatattgaaaaactctacttatataaagaaaataatttaataaaatacaagacaattcaaatcatagaaaacacaagaaaaatcacatattatgatacaaaagatacaaaaagaaaagaagaaatttacgacaatttaaataataaaatacaagaaattgaatatggcaacaaaggaaaaattcttgaaacagtaaattactattatgaaaacggcaacttaatatccaaaaatttaaaaaccaaaaaccaaaaaccaaaatcaatctattattctaaagatgaaaatggcaaattactaaaaataacaggatcggattttcaaatttggaactatggaattaatggcgacataaaatctacatattttgacatcaaaaaatcaacaacaaaagtgataaaatatgacgacaaaaaaagaagtttagacagcgcaataattgttaataataaaataaaatctaaagaaaaaaaccaatatttagatgaacaaaaaacagtaaatatttttgaagaagaaaattcaaaaattatatctacctatcaaggaaacaacctaattaaagaagagatatataaaaataatgaacttataaaaataaatgattttcaatacaactcatctgatatgatgattcttcaaagcactaaagaaaaggataaagaccaatacaccaatactaaaattgaatatgaatataaccaagacaaccaattaaaaagcaaaaaaatttatgaaaacgatacaatttatctaaaaaccgaataccacaatgataatgaatatgaagaagaaatttactacaataaaacccccgctcttagagtaaaacacaaaaatggaaaagtcaccgaagaaaaaccaataggaacaaat

SEQ ID NO: 6 - DNA, 1251 bp, Borrelia afzelii
atgatgcttttaaagctaacagaaattacaaaaattgcgtatataatttttaaaaattcaacaaataaaatagctttaataggttctggaatatcattaagtttagtaatgatcccattaattattgtctactatatgtctagtaatattatgacttctactattaataaatatattgaaagtgaaggattttccacgcaaatagaatataatgacacaaataaaactcatcaactaaaagacagattagactcatttaaaaaaaaatataattacaaagatttaaattatttttttgagaaaagaacttatggaattattggaaataataaaaaacaaggtgtattaataagagcaatagaaaataaattcatattggaaaacaaatcaataaaattactacaaggtgctaaaaatttaaaaaaggattccatactcatttcaaatcaaataaaaaataaacttaatttaaatctcaatgaaaaaattgacattttgattccaaatacaaaaaacaataaaataatgcccagaataaaaaagtttaatatctcaggaataattgaaaccggactaaaagatattgataataatttggtgttaatttcttttgaaaacgaaaatttaatgtcaaaaaagttttcaaaaagcataattggagttgaaacaagttcaaattacataaaaaacaatgaaatcttgaagcagaatttagaaactgaatttaaagaattccaaataaaaacattctatgaactttacttaaataaatacaataatctagatataagtaaaaaacttttaatattcattatggctttgattataatatttgcaagtatcaatatatcctcgtccctttcaatgcttatttttgaaaataaaaagaaaattgcaatactaaaatcaattggaatgaataatttaaatataaaaataatatttcttttgatatcgctcacattaagcaccaccttttgtggaattggaataataattggaaattatttaacacttaaaatatcttatttaataaactttgttgataatgttttaaacttttttttaaaaatatttggagaagaatattctgaaatattaaactcagaatattacgtatctgaatttcaaatacatttaagcttaagctttagcttaacacttcttggcttatatatgctaataagcattttaactacaatgattccgcttaacattatctccaatctaaaagaaaaaaaaatcttgaga

SEQ ID NO: 7 - DNA, 432 bp, Borrelia afzelii
atggatataggtttaataggagttaattcagctttgacaatctcagcaataggttctgcgttgggtatgggagcagcaggcagcgctgctattggagcatggaagaggtgttatatgcaaggaaagcccgcaccatttttattgattgtttttgtatcagcaccattgactcaaataatatatggatatattttaatgaacacgttatatgaggtaatgatgcagacaaatccgtggctgttacttggagctggtcttggtggtggatttgcgattgctgtttctggatttgctcaaggtaaagctgcagcaggcgcttgtgatgctttttctgagactgggaagggatttgctacatacctattagttttggggctaatagaatctgttgctctttttgtaatggtatttttaatgatatttaagtttgtt

SEQ ID NO: 8 - DNA, 1725 bp, Borrelia afzelii
atgaatacaaaaggaaaagtcgttggagtaaatggaaacttagttactattgaggtagaaggttcagtttctatgaatgaggttttatttgtaaagactggtggtagaaatttaaaagcagaagtaatccgtgttagagggaatgaagttgatgcacaagtttttgaattgacaaaaggaatatctgttggagatttagttgaatttacagataagcttttaacagttgaattaggaccaggtcttttaactcaagtgtatgatgggcttcaaaatcctttgcctgaactggctattaaatgtggattttttttagaaaggggagtgtatttaaggcctttaaacaaagataaaaaatggaattttaaaaaaacctccaaagttggagatagcgttattgcaggagattttttgggatttgtaattgaaggaactgttcaccaccaaataatgattccattttataaaagagattcttataaaattgtggagattgtaaatgatggtgattattcaattgatgagcaaattgctgtaattgaagatgattctggtatgaggcatagtattacaatgtctttccattggcctgttaaaattcctattactaattacaagcaacgacttatccctagtgagcctatgttgactcaaactagaattatagatacattttttccagtagctaaaggaggaactttttgcattccaggtccttttggagctggaaaaacggttcttcagcaggttacaagtcgaaatgccgatgttgatatagtaattattgcagcttgtggtgagcgagcaggtgaagtagtagaaactcttaaggagttccccgaattgatagatccaaaaactggcaaatctttaatggataggacttgtattatttgtaatacatcttcaatgccagttgcagctagagaagcctctgtttatactgctattactattggtgagtattataggcagatgggtcttgatattcttcttttggcagattcaacttcaagatgggctcaagctatgagagaaatgtctggtcgccttgaggaaattcctggtgaggaggcttttccagcatatcttgagtctgttattgcttccttttatgaaagggcgggcattgtagttcttaataatggtgatattggatctgtgacagttggtggttctgtaagccctgctggtggcaattttgaagagccagttactcaagcaactttaaaggttgtaggagcattccacgggcttacaagagaaaggtctgatgctaggaaatttccagctattagtcctcttgaatcttggagtaaatataaaggtgttattgattccaaaaagacagaatatgtaagatcttttttggtaaaaggcaacgaaattaatcaaatgatgaaagttgttggggaagagggaataagtaacgaggattttttaatttatttgaaatctgaactgcttgattcgtgctatttacaacaaaattcatttgattctattgatgctgctgttaattcagagcgtcaaaattatatgtttgatatagtttataatattcttaaaaccaatttcgagttttctgataagcttcaagcaagagattttataaatgaattaaggcaaaatcttttagacatgaatctttcttcttttaaagattctaagtttaataaattagagcatactttgagtgaattggtaaattttaaaaaggtaatt

SEQ ID NO: 9 - DNA, 1194 bp, Borrelia afzelii
gtgatgaaaaaagtagctattattgatggacttagaacgcctaatactaagtttggaggttcgtttagaggtttagatattattgatgaatcttcaaaagttgttaaagctttgcttggaagaaataagttatgtgaagtggatgaggtcattattggaaatgtaatatctgcgggacttggtcaaaatattgcaaggcaaattgctttaaagtctaatttgggcgatactgtgcctgcatttagtgttaataaggtttgtggttctggtcttaaggctttggaacttgcatttaactctattgttcttggaaacaatgatattgttttggctgggggagtggaagatctaaccaattctccttatttattgcccagaaagattagatttgacggtcttaaatttggtaattttgaacttgaagattcaattcaaaaagatgccttaatagattctctaaattttatttctatgggacttacggcagaaaatctttcagaaaaatataaaataacaagagagatgcaagatgaatttgcatataattctcatgtaaaggcattgaaggcaagagaacttggatattttgaagatgaaatttatcctttgactgtttttgataagaagactaattctagcagggttgtctcaagcgatgaggaaataagagataatgtaactctgaataaactggcatctcttaatcctgtttttaaagaattaggcacagtaaccgctggaaattcttctagtttaaatgatggggcttgttttttaattttagcaagtgaggaaaaagcaaaaagcttaggaataagtccattagcttatattggaggatttaaaagtgtagggcttgatccgctttatatgggttttggagcttatgcagctattgaaggcattattagtaaattaagtttaaaccctagcgaaatagatttgattgaagtaaatgaagcatttgcggctcaagcattaagtattgaaaaggccttgtttaaaaaatacaatataactagcgatattattaatataaatggcggtgctattgctttagggcatccatttgcagttagcggttcaagaattttattaacactttctcgttctatgaaaatgaagaataaagcaaaaggaatagcatctgtttgtgttggtggcggacaaggaatttctagttttttgtataga

SEQ ID NO: 10 - DNA, 1659 bp, Borrelia afzelii
gtgagaatggaaaatcaaaaagatttacaagaaaattatttgaaagtacttgaaagggtagaacttggaagtcgtgtttctggaacgattgttaacattatgaaggattatgttctagtcgatgttggctataaatctgaaggctttatcaagattgaagaatttgaaaatgttcccaaaattggtgataaacttgaagcaatcgttgtaagaataggtggagaattggggctgattttaagtgttgaaaagcttgattctttgaattttcaagataaagtaaatgagtatattcaaaataaaaaagtaattaaaggtaaagtgttggttgagctttctaatggctataagattcaaattaatgaaaatgtttctggctttatgcctttttatttaagctctaaatctaaggatgagaaattaaaaagaggctctattgttgaattttatattcttgaagcaagcgaaacggacggtttgaggcttattcttgataggcgcactttagaaagagaaagggagcttgccaagagaatagagctagtaagttcttataatgaagaagatgtggttgatggtatggttgatcgtattacagaatatggtgcgattataaaaattaaaaattttgttacaggaattttacataaaagaaatattgcttttaatcaagttgaaaatattgaagattttattagagttggtgataagttaaagttgaaaattattaagataaatccacaaacaggtaaaatggaattatctcttaaggccttaaaagcaaatccttgggattctgtagatgttaaatataaaattgatagcattgtaaaagggaaagttgtaaaaattttgccctttggagctgttattgagcttgacagcgaattgtcagggtttttacatataagtaatttttcttggataaaagtagtaaagagtcctcaagaattaataaaacttggtcagatggtagaagttaagattttagagatagacaaagaaaatcaaaaaatatctctgggtattaaacaaattaatgagaatccttgggagagattaactgagaaatatcctattggaaaggttattcaaggagttgttactaatattacaaaaacaggcgcttttgtaaatattgaagaaggcatagatgcttatgtgagcaagtttgatatttcttggcttgaagagattgatcctgaggaatattttaagataggcgatttagtgaatgggaaagtgcttgaggttgacaggcgaaagagaaatgttagattaggaattaagcagttagaagagagtccttgggaagatttttctaaaagctataaaaaaggtgatgctattgaggttgagattgtagagaaaaagtcaaaaggctttcaagtaagagtttataataaaataatgggatttattagcaaaatccaactaggagatacaaaagaatccagtttagaaacttttgaaaaattaagcattggagataagcttaaggtggtaataacaaatattgattctaaagacaaatcagtgctgctctcttatagggagtatgagaatcaaaaatcaagagaagagatttcttcttatttatttaagggtaatgatgaggaatcttataagccgtttgaaaatttgctaaagagggatgaa

SEQ ID NO: 11 - DNA, 1884 bp, Borrelia afzelii
atgaccaaaagacttaataataagtatcggacaaaaacaatattaacaatattcttaggtataactttgctaactgtttacaaatatttcacactaatggtctttaataacagtccagacaacataatatctttaaagtcaaatgatattgtcaaaagaggaacaatttatgatagaaatggcaaaccaatagcattctcttcaaagtcctactcaatcggaacaaatcctcaaaaaatagaaaatattgtcagcacatctgaaactcttggcgcaatactccaaattgattcaagaattttaaaagaaaagctttcttcaaataaaggatttttatacataaaaagaaaaataaaaagggaagaatcggatttaatcaaaagaattcaagctgaaggcaggctctcaaacattactttatatcctgattatacaagaatttatccttttcgctataccacaagcaatattactggctttgtaggaatagataatcttggacttgagggaatcgaattttctctaaatagtatattaggaacagataaaactagacaacaatttttaaatgaagaattagaaacaaataatatttacttaacaatagatatgaatatacaacagggtgttagcaaaatagctgaaaaatactttaaagaaaataatcctgaaagtttaattactttagtaatgaactcccaaaatggagaaatattgtccatggttcaatttcctcaatatgatgcaaacttttattctgaatatcctgaagaaatccgaaaaaacctttcttcatcgttaacctatgagcctggaagcattaataaaatttttacagttgcaatattattagaaagtggaaaattaaatttaaaagaaaaatttttagacaatggaatatatcaaaaacaatttccatcaggagagaaaattacaatcaaaaccttaaatcctccctataaatacattgactctacagaaattttaatttattcatcaaatgtaggaatagcttacattactgagaaagttagcaatgaatacttttacaaaaaacttttagattttggatttggggaaaaagttggatttccatttcccggagaaacaaaaggactgttaaatcattattcaaaatggtcaggacgaagtaaggctacaattggatttggacaagaaataggggtatcagcggttcaaatattacaagctgcaagcatactgggcaacaatggaataatgttaaaacctagaataataaaaaaaataagcactgacaaaggagaaagtattcaagaatttgataaagaagaaataaaaagggtaatatctaagaattcagcacaaaaagttttaaaaatgatgagagaagttgtaaataaaggtggaattccaaatcttaaaattaaaaatctcgacatttctgcaaaaagcggaacatctcaggctattgatagaaaaaccggcaaatactcagaagaagactatacagcctctatcttggcaatataccccacagaacaaccaaaatatattatttatattgtatacagatacccaaaaaaaataatatatggaacaagaatagcagctccaatggcaaaagaaataatagaatttattgaataccaacaaaatacaaacgcatataaaaaaattaaaatgccatcaaaaatcaaaattcctaaaaccgacactaattataaaaacaaagaatacttgccaaattttatcaatctttccaaaagagaatcaatagacatactaaaatactatgaaaatacaataaaaataaaaataaatggcgacggatttgtttacaagcaaagcatatctcccaatacaaaattagaagatatagcagagcttgaactgtatttaaaa

SEQ ID NO: 12 - DNA, 1008 bp, Borrelia afzelii
atgattataaatcataatacatcagctattaatgcttcaagaaataatgccattaatgctgctaatcttagtaaaacccaagagaagctttctagtggttacagaattaatcgagcttctgatgatgctgctggtatgggggtttctggcaagattaatgctcaaataagaggcttatcacaagcttctagaaacacttcaaaagctatcaattttattcagacaacagaaggaaatttaaatgaagtagaaaaagttttagtaagaatgaaagaattagcagttcaatcaggtaacggaacgtattcagactcagacagaggttctatacagattgaaatagagcaacttacagacgaaattaatagaattgctgatcaggctcaatataaccaaatgcacatgttgtcaaacaaatctgcttcccaaaatgtaaaaacagctgaagagcttggaatgcagcctgcaaaaattaacacaccagcatcactttcaggatctcaagcttcttggactttaagagttcatgtgggagcaaatcaagatgaagcaattgctgtaaatatttattcagctaatgttgcaaatctttttgctggtgagggagctcaagctgctcaggctgcacctgttcaagagggtgctcaagaagaaggagctcagcaaccaacacctgctacagcacctactcaaggtggagttaattctcctgttaatgttacaaccacagttgatgctaatacatcacttgctaaaatagaaaatgctattagaatgataagtgatcaaagagcaaatttaggtgctttccaaaatagacttgaatctataaagaatagcactgagtatgctattgaaaatctaaaagcatcttatgctcaaataaaagatgctacaatgacagatgaggttgtagcagctacaactaatagtattttaactcaatctgcaatggcaatgattgcacaggctaatcaagttcctcaatatgttttgtcattgcttaga

SEQ ID NO: 13 - DNA, 1995 bp, Borrelia afzelii
atggcatcaggattttttgttcctggacttgagagcaaatataatactaaagaaattcgtgaatccatgcttaagcccgataaagccaaaattgattcttcttttaagaaacttgaatctttagagcaagagaaaagtgcttggcagttaattaatagaaaaatctctactttaaattctcttgcaaaagaattgacctcacttaacagtccttttaatttaatgtcaggaaattctagtaatagtgaagttttgaccctgtctactcgatatggatctaagaatgagactcacaagttaattgttgatcaaatagcgtcagccgatgtttttttgtcttcaaactttgatcctaaaaaagttacaattccagaaggagaatatgtatttttagttggcaagaaagaaattaatgtaaaaagtaatggtaacattgatttacttgtaagggatattaataacaagggaaaaggctttttgtctgcaaaaatagtaaaaagtgataaaaacgggaatagtcgttttattttgcaatccttaaaggaaggtaaagaaaataaacttattataaaaggggaaggattagcttttgctaagcaaattggcattttaagcgaattgaaaaccaattttaatcccaacctttcagatattgttgtaaatcaatctagtagtaataatagacttgcttttgaaaataataatcttgttttaaatccactttcagaggtgtcgattgaaatccctgaagatattgaaattacatctaggagtaaaattaaatttgaagttaagtattttgatacaggtttagaagagtctgatagtaaaattatttttaatcctggagaagctacatttaaggatgcaaaagtcgacagtgaagatagtgtggttgatcttggatctgatttaaaaactcctttggaaaaaaaatatattcaaatgaatatggttaaaatatctagcaaggaaggttccttggagcttcctttaataaatatttcaaataattttgaagaagttgaagttgatattggagctctttctaatttagaagaaataaatattgaaaataaagcgaataataaagtagttgtgattagtaatgtcgaagtttttgatccaaaaaatagagatggttatttgccaataaatgctaaaagttttgctgagaatgcaaaaattaaatttgatggagtagatgttgagagagattcaaatgttattaatgatttagttccaaatgtgacattaagtttaaaaaaagcttcaagcgatatggttgaggctaaggttgagcccgattatgaggggattaagagaattcttttagattttattggtgcctataatgaggttcttgctgagattaatattgtaagttccaacgaagatcaacttggtaatcaaaagtctagtatagttgaagaattgacttatcttagtgagtctcaaaaagaagaggcttataaaaatttaggcattctaaggtctgaatttttattaaaaaatcttaaatctagactagaatctataatttttaagccctatgttactagtgatcctaatttttcaataattaatcagataggagtttttactaactccatttcttcttctggtggactttctagatatttaagacttgacgagaaaaagtttgatgaatcaattcgcaataacattgataatgttagagaactttttttatttgaccttaatggtgacagagtatatgataatgggattgctaaaatgctaggagattgtttgtctccttttgtgacttctgggggagttatttataataaaataaaaaattacgacttgaagattattgatcaaaaaaataaagttgaagactataaaaagaagtacgatgatagagaaaggaaaatagaaggagaacttaacaccttagattttactgttaagcgcatgaaagatcaagaaaatacattaaaggcttttgattttaatcagagaaataga

SEQ ID NO: 14 - DNA, 1203 bp, Borrelia afzelii
atgctaaatttttgtttattcaactcaaaatccgttttaactggaaatgacaaactagataattcagcggtcctaattaaagataataaaatttttgatattgtaacatctgataggcttaaaaaaatggatcttagagaatatcaaatgattgatacaaaaggcaactatataactcccggactttacgacagccatattcatggatttcacggttatggaacagaccagtgttcaacagaatcaatacttaaaatgtcagagcatttagcacaatatggcgtagtaggatttttaccaactctttatccaagaccaatagatgaaatgattcaaataataaaagcttgtacagcagcaattggtaaagaaaagggagctaaaattctaggacttcaccttgaagggccatttttttcccctgaaaaaagaggagcgcaccctgtttcttatcttcatgagcctagcattaaagttatgcaaaaactaatagatgctgctggcgggatatttacaggatcaaacggcaaaagaaaaacacacataaaaacaatgactgttgctcccgagcttaaaggaatgagagaacttgcaatattttgccttgaaaataatataaaccttcaagcaggacacacaaacgcaaaatatgaaaatatgatcgaaggatttcaagttggaatacttcacacaacccattttttcaacgcaatgtcaaaacttgaccacagaaatccaaacgcaataggagcagtattaatacacggtgacgtttcttgtgaaattattgcagatggtcatcatatacacccaaaattagttttaatgcttagaaagcttaaagatataagtaaaatagtacttgtaactgatggacttactccaaattttcaaacttctggaaaactaattgcaaacggagatgaagtttatattgcagaagatggattattccacagcgtaaaaagcaacacaatagctggatcaacacttacaatgatacaaggtcttaaaaatttaatagaattcggctacagtttgagcgatgctgttcaagcaagctcttacaatccaacaagaattcttaatattgacaaaaaggggttaatatgccatggatacgatgcaaacatcaatgtcttagataaagattttaatctaaaattaacaatgatagaatctaaaataatttttaacaatctc

SEQ ID NO: 15 - DNA, 1881 bp, Borrelia afzelii
gtggattcaacattctcaggaatagaaattggcaaaagaagtttatttgcacataaagatgctatgaatacagttggtcacaacttatccaatgctacaaaacctggatattcaaggcaaagagtaacaatgaaaaccgcaattcctctttatgctccacaactaaacagagctaaaaaacaaggacaattgggtcagggaatcgtggttcaatctatagacagagtaaaagacgaactacttaacacaaggatcattgaagaatcacaccgactaggatactggacttcgcaagacaaatttacatcaatgttagaagatgtttataacgaacctgaagatcagtcaataagaaaaagattaaatgatttttgggaaagttggcatgatctagcaaatcaaccacaaggtttggcagaaagaaagataatcttagaaagaggcaaatctttttgcgagggaataagaagcagattccattcgcttgaaagaatttacataatggcaaacgatgaaataaaaattacaacagatgaggcaaacaattacattagaaacattgcaaatcttaataaacaaatttcaaaatctcaagcaatgaaagacaatccaaatgacttaatggatgcaagagatttaatggttgaaaaattgggcaatttaataagcgtatcaattgaaaacaaacagaatcccaatgaatttttaattcactcagaaggaagacaccttgtacaaggttcaattgctaatgaatttaaactagaagctacaaacggacctaccagaaccagatggaacattttatgggcaaataatgacaaagtccaccttaaaacaggaaaactaggggctttgcttaacataagagatgaagagattaaaaatgaaatcaatgaactgaacaatctagctgccaacattatagagcttgttaacgaaatacatgagacagggcatggaatggataaaaaaagcggaagaagctttttttatcaagaactcaaactaactgacgatcgcggtcgatatgatactaacggaaatggccaatttgattccgttcatattttcaaaattaatagcacaaacgaaatattcccagaagagaaattgggattttatggaactcttaaatttgagactacaaatagcaatgagattgtagaaataccttacaatgctccagatacggttcaagatgttataaatagaataaacaattccgatgcacaagttacagcaagaattaactcagaaggcaagcttgaaatcaaagcagttaaagaacaagaaaatgagaacataacatttagaatcaagcatatagaagattctggattatttctaacaaaatatacaggaatattaaatgaatctggacctgagggggcttatgattataaaaatattgacacaacagacaaattaacgcccaaatccacttattcaatctcgcctttaaaaaatcctgcagcatggataaaagttgcagacacgatagactcagatccttcaaaaatagcatcgggaatcaaaaatctaacaaatgaaatatctattggggataatcaagcagcactgagaatctcctcttttggaaattctcagattatgattggcaaaaatttaacattaaatgattactttgcaaatacagcatcaaatatcgcgataaaaggacaaatatcagaaatcacaaaagaaagccaatctcaaatattaaaagatttgacagatctaagaatgtctatttctggagtaaacaaggatgaagaacttgcaaacatgatcgaatttcaacaagcctttattgcagcaagtaaatttatcactgtttctgctgagctaatagacacagtaataaataaaatgggagta

SEQ ID NO: 16 - DNA, 753 bp, Borrelia afzelii
atgttagaaaataaaatgactggcccaaaaacactcgttgtaattgcgatcttagcaattttaacacaaggatgcaaaaaatattccattattgaaaaacaatttgattatgcaataattttctcggatgcaaccgaatatttttttgaaattcaaaaaactccattcataaaaaacaaaatattatttataaatgataaaaatttagaaattacaaaagacaagcttaaaacaacaaaaaaaatactattaacccacaaatcaaccaatgaaatactaaataacgaaattctaaaagaaaaaatttttcatctatcaaaaataaaattttctctaaaaaagtctattgatctcttacttaacggaaaatcaatagacttgcaaaaaacattactatttagagacaaatctctaaataacgaagatcttgaatacttggaaaaaaaaagccaagaaaaaaatattaatattaccctaataaacgaagcaaacatatcctatataaaaacatttattactccccaaatacaaacaataatattgttctctttaagagataataatattattttaaaaaagatatcaaattcgccttttttcaaaaatataaaatttgtattaattggcaatacaagaaaagacttaaaaattattaagctaaaatatttaatcacccttaaagaatctgatttaatgaaaatagtaaaagaagttgaaaaaaattttcaatatgaatttaatatttataaacaa

SEQ ID NO: 17 - DNA, 1083 bp, Borrelia afzelii
gtgaaaaaaaatcttatgttaatatttggcggtgtttcttttgaacatgaaatttcttgcaaatctgcttatagcgtttatttagcccttttagatttaaataaatacaatatttattctgcttatattgataagtgtacaggtatttggtatttgttagattctgtttctgatcccccaaagcctattgatacagatgttttacctattgtcagtttattaccaggttttggaattttttcaaataacaaaaatcttgagattgatgttgtttttcctgttgttcatggtagaatcggtgtagatggtgctattcaaggagttttaaaagacatggacattccatgtgttggtgctggtattatagggagtgctatttctagtaataagtatttttgtaaacttttgcttaaaagttttaatatccccatagtgccttttattgggtttaggcaatatgattattctttagataaagaggaaataaaaagaaatgtaaaggaggttttaggctaccctgttattgttaagcctgcagtattagggtcttcgattggaataaatgtagcttatagtgaaaatcagattgaatcttgtattgaggaggctttaaagtatgaccttactattgtaatagagaaatttattgaggctagagagatcgaatgttctattattggtaatgaaaagatgaaaatattttctcctggggaagttgttgtacaggattttatattttatgattatgatgctaaatattctgttattcctggaaattctattatctttaatatccctgcacatcttgagacaaatcagttgttaagcattaaggaatatgcttttcttgtttataagaatttagaactcaggggtatggcaagagttgatttttttgttgaaaaaaaatcaggaacaatttatcttaatgaaataaatactattccaggatttactgatatatctatgttttctaaaatgtgtagccatgatggtcttcagtttaaggacttgatagataatttgattgattatgcttttcaaagttatattaataggaagaaaaggattaattttaaagat

SEQ ID NO: 18 - DNA, 3201 bp, Borrelia afzelii
atgaataaaaaacgtacaaatttttcggtattattgcttttaattttcttacttatcttatcatttggaggctttggatactatatatatcaaagcaaattaaatgacaaaaatcgagaaataatgctaaacgaagttaaaaacagtgtaatagatcgaaactataaaaaagcatattctgttgcaaaacttctgcaagataaatacccgcaaaatgaagacattgcaatgcttacaaatacattagcagaaatcgccaacagtagcccttttgaatcaaacgacttacaaagagattctgcaaatcaaatcttagataagatcaaagttcaaggcaatgtaaaaacaaatgtaaacgaaaattttgatatcgcatttaataatagatacattaaagacagcacaataacagaaaactactctgacagaaacgatgacgttggtattgaagatgaagacatatctgaatttaaaaaaagcaaaatcccagaaaaaataaatcaaaatacacaaccaaaaaaagaagatcaaacaatacaacatccaaatcccaaattaaatgttaatgatcaaaaaaatttattttctttggaaaaattaaaaaaaaatttaagtgaaaactcaaacaatgaaaatattttaaacaacccccaaaaaatagaaaataatacgcaaaacacaaatttacccaaagaaaaaaattcagaacatattttaaaaaccttagacaacaataaatatttaaacaataataatgctatatctttaaaagagatgccttcaaattctaaagaagaaagtgacctttctccacccagccaaacaataataggaaaaattcataggccatatagttacttaataaaaaaagagctttacgaaatattagacaatattaatactggtagagtcacacttggaaaaaacagattaaaagaattaattaaaaagggtttaagcaataaatttcaaaaagtgaatgaattgattgaaagcttaaaaactaaagaagcctccaatttactattaaccttaataaaaaaagacattgagccaaatttaattgatataccaaaagatccttacaaaaaagacatttttcaattaaataaagaaaaagaagataatagaatacaacacttggaagaccttaaatctaaggtctattcaataaagcctggtgatcttgaaaactcaaaaacacgtcaacaagccattaaagatttaaatgaattcttgataaccaatcccaatgatgcctatgcctctaaaactttagctcaagctaataaaatacagcaattggaagaccttaaatctaaggtctattcaataaaacctggtgatcttgaaaacccaaaaacacgtcaacaagccattaaagatttaaatgaattcttgataaccaatcccaatgatgcctatgcctctaaaactttagctcaagctaataaaatacagcaattggaagaccttaaatctaaagtttattcaataaaacctggtgatcttgaaaacccaaaaacacgtcaacaagccattaaagatttaaatgaattcttgataaccaatcccaatgatgcctatgcctctaaaactttagctcaagctaataaaatacagcaattggaagaccttaaatctaaagtttattcaataaaacctggtgatcttgaaaacccaaaaacacgtcaacaagccattaaagatttaaatgaattcttgataaccaatcctaatgatacctatgcctctaaaactttagctcaagctaataaaatacagcaattggaagaccttaaatctaaagtttattcaataaaacctggtgatcttgaaaacccaaaaacacgtcaacaagccattaaagatttaaatgaattcttgataaccaatcccaatgatgcctatgcctctaaaactttagctcaagctaataaaatacagcaattggaagaccttaaatctaaagtttattcaataaaacctggtgatcttgaaaacccaaaaacacgtcaacaagccattaaagatttaaatgaattcttgataaccaatcctaatgatgcctatgcctctaaaactttagctcaagcttatgaaaacgatggagatttactaaaagcagaaagcgtatatgacaaaattaccaaactcacaaatgccaaagaagattactataaacttggaattattagatttaagcttaaaaagtatgaacactcaatagaggcatttgatcaaacaataaggctcgatccaaaacacaaaaaagcacataataacaaaggaatagctttaatactgctaaataaaaacaaacaagcaatagaatcttttgagaaagcaatacaaattgataaaaattatgacactgcctactaccaaaaaggaatagcggaagaaaaaactggcgatatgcaacaagcatttgtaagttttaaaaatgcctacgatctaaacaaaaaactcaattacgcattaaaagctggaatagtatcaaacaacctgggcaacttcaaaaaaagtgaagagtatttgggattttttaatgataatgtaaaaaaacctaacgaaattgctatttataatctatcaatagcaaaatttgagaacaataaacttgaagaatctcttgaaataataaacaaggccatcaatttaaatccagaaaaaagtgaatatttatatttaaaagcatccataaatcttaaaaacgaaaattatcaaaatgctataccactttacaacttggtaattgaaaaaaaccctgaaaatatttcagcttacataaacctagcaaaagcatacgaaaaatcgggaaataaaactcaagcaatctcaactcttgaaaagataataaacaaaaacaataaattagccttaaacaatcttggaatactttacaaaaaccaaaaaaattatcaaaaagcaattgaaatttttgaaaaagcaataatcaattcagatattgaagcaaaatataatcttgcaaccactctaattgaaattaatgataatacaagagctaaagaccttctaaaggaatatacaaaattaaaaccaaacaatccagaagccttatatgcactcggaataatagaatataatgagaacaataatgatcaaacattaagggaacttattaaaaaatttccaaattataaaaaaaatggaaatattaaaaaaataataggaata

SEQ ID NO: 19 - DNA, 840 bp, Borrelia afzelii
ttgatgaaaaaatttattatcttaatttttatgctatcaacaagtttattatacaactgtaaaaatcaagacaatgaaaaaattgtatcaattgggggatctacaactgtaagtccaatactagacgaaatgattctaaaatataataaaataaacaataatactaaagtaacatacgatgcacaaggaagtagtgttggcataaacggactatttaataaaatatataaaatagccatatcatcaagagatttaacaaaagaagaaatcgaacaaggcgcaaaagaaactgtattcgcttatgatgctttaatttttatcacaagccctgaaataaaaattacaaatattacagaagaaaatctagctaaaatactaaatggaaaaattcaaaattggaaacaagtgggagggcctgatgctaaaatcaactttattaatcgagattcttcctctggctcttattcgtctataaaagatctacttcttaataaaatatttaaaactcacgaagaatctcaatttagacaagatggaatagtagtaaaatctaatggagaggtaattgaaaaaacaagccttactccacactcaataggatatataggtcttggatacgcaaaaaattcaatagaaaagggtttaaatatactttctgtcaacagcacataccctacaaaagaaacaataaatagcgataaatacactattaaaagaaatttggtaatagttacaaatagcaaatacgaggataaaaacgcaactcaatttattgattttatgacaagctcaaccggacaagatattgttgaagaacaaggttttttagggataaaaaaa

SEQ ID NO: 20 - DNA, 1224 bp, Borrelia afzelii
atgaaggttatgcaggatcctaggctttctaagtataaaaatactaaaaatttaagcaaaaaaaccgttgaagaaattgatactttgagcttaaataaaaatttttccgattcagagattcaaggttctatgcttagatcttggataaatcttattaagggtaataaaaataaaacacctattgagtttaaatccaataatattaatgatttaaagccagggtttattcgcaaagagagtaaggttacaaagattgcaaaatattttttggctattgggcttgaaaaatctgcaaagattatgtctgagcttgatgattcggatataatcttaattatttgtgtagtttttaagattaattacattgctccagaagaaaaagatcgtattattaaagaatttgaagagttgctaagaaatgaaaaaaggtatgttaaagttgataataactttgcttatgatttattgaataaaacgttaggaaaatctaaagcaaaatcaatttataaaaaagttactggcaatgatatttttattccttttgattatttatctcaaattgagcatgaacaactttgggcattaattaaagatgataatattaaaacgcttgtcatattatataattatttaaataaagatcaaaaaaagtatgttttttcaatgctaggagaagaaaagagaagagaattcgtaaaagatcttgctaaagcaaggcaattaagcatggagacaatagaggcaatttcaaataaacttaaggataggtttaagatgcaagggagacttaagacagataaacttgacggatctaaaatatttgttgatattttaagctatatggattctaatgaagagaaaaatctgcttaataaaattaatatgcaggatttaaatcctgctgtggacaatgaaattcgagaaaaaatatttgatatcaatgtaatattgagaataatggataatgatttgcataatattttaagagagtttacagacaaagagattgcaattattattaaagataaaactgatgaggttagagataaaatgctttcaaatgtttcaaaaaggcgcaaagaaattattttagatgaggaagcttttttaggaaaaataagccaaaaagatttaaaaaccatgacactattttttattaattatattaaaaatttaactttaaaaggcgatttgacaatatatagaaaaaatgaggaatttatt

SEQ ID NO: 21 - DNA, 2004 bp, Borrelia afzelii
atgttgatttttggttttgttggtttgtttttttttaatttttttaatttacatgctcaaggaatagttaccaataaagatgctcaagaagagtttaaatgggctcttaattcctataataatggaatttatgatgatgctcttttatcttttaaaaaaattttaagctttgatcctaataaccttgattatcatttttgggctggcaatgtttattatagactaggttatgttgaagaagctttaatggaatggagaaatttaaaagatcagggttataaggtcccttatcttaggcatttaatttctactattgagcaaaggagaggtattttttcaaattatgagcttaagtttaaaaaacttgtaaaagttgcttctcttgataattctatttataaaaggccacatgggtatcagattacatctttgagggctgataagtatggtggatattatgctgcaaactttgtaggtaatgaaatattgtattttgatgttaataataatgttaatgctttagttaaagatggatttagttatttaaaatcaccttatgatgttattgaagctaatgatttgctttatgtgactctttattccagtgatgaaattggtgtttacgataaagttcttggagttaaaaggagatctattggaaaaaaaggcacaaaagatggtgaattgcttgctcctcagtatatggctattgataagagaaattatatttatgtgagtgagtggggaaataaaagagttagtaaatttggacttgagggtgattttattttgcattttggttatagaacttcgggctacaagggtcttttaggccccacaggcgttacttatttgaatgaaaacatttatgttgcagattccctgagaaatactattgaagtttttgacactagtggcaatcatttgtattcagtttttacttctattgaaggaatagaggggcttagtagtgattctgttggaaacaatgttatagtatcttcaaaagatggtgtttataagtacaatattgctaaaaagacaattacaaaaattttaaaagcagataaattgaattctaaaatttcttcatctattttggatgccaataatcagatgattgtctcagattttaataatgccaaggtttcagtttacaagagtgattcaagtctttatgacagtttaaatgttgatgttagaagaatagttagacttggggggcctaaaatttatgttgagcttaatgttagcagtaaaagcgggttaccggttgttgggcttaagagtgaaaatttttcaattgcaaatgaaaattattacattgttaatcccaaggtagcgtacaatgtaaatgcttcaaaagatattaatatagcagttgtttttgataaatcttcttatatgaaaaattatgatttagatcaaatcatgggtttaaatactttaatagagtcgtcaaaaaataaaaactttagttttataaatgcaacaaatgtgcccattatagataatattgaaagcttgacaaatagcattaaaaacacaagttctcttggtccttatagtacagatactgtaaaaacagatgttagtttgaagttagcaggttctggacttatgtcaaaaagctcaagaagagcagtagtttattttagtggtggtgttttaaatcgtaaagcttttgaaaagtactctttagatacaatagtaagctattataaaaataatgatataagattttacttaatattatttggcaacggtcttgttgatagtaagcttcaatatttagttgatgaaacaggcggtgctataattcctttttcatcttatgaaggagtgtctaaagtttatgatttaattttagaacaaaaaacgggtacttatttgttagaatattattatccaggccctcaagagcccaataaatattttaatttatctgttgaagcaaatatcaatcaacagactggaagaggggagtttgcatattttattaat

SEQ ID NO: 22 - DNA, 771 bp, Borrelia afzelii
atgaagagattatttcttctgtattttttatgttcttttgtttttttgaatttgtttgcccaaggcaattcttcttatgttgataagcaaaaagagcttgctattttttattatgaggttggtcaaaggtatataaatgttggtaaaattaaaaaggggaagcttttccaagcaaaagctttaaagatttatccagatttgaaaaagggagttgatatcaagcttgcagttaaggagctggatgctaggattaaggatggcaattccaaggttgttatgcttgaggatgttaagcttgaggagatacctggaatagtgcacgaaaaaatagaaatcaatgattttacaaatgctcctaaaatagaatatattgctcaaagagagagaagtaaaaatcaagataaaattattaaattccaatttggaaagtttgcaagagctttaatttctcagaactttgatttatttgactctgttattgcaaataaggttaatgttatgggtcaatttgaatcaaaaaatgattttatatcagctttatcaagagcttcatctaaggttgatgcggatgagctagagtatttgtcagttgatgattattacgatttaaagtctttgaaaatttcaaaatctaacgatacttcttttgctgttaatgtaaatgccaagaaaaacgatgttactaaaaatttctcattttggaaagaacatcagactttgatttttaccaaagaggatgataatgacaattggtttttgtcttctataaag

SEQ ID NO: 23 - DNA, 1326 bp, Borrelia afzelii
atgatgaggtctttatattctggtgtttctgggcttcagaatcatcaaacaagaatggatgttgttggtaataacattgcgaatgtaaatacaattggttttaaaaaaggaagagtaaattttcaggatatgatatcacagtctatttcgggagcctctcgtcctactgatgttcgtggtggtactaatcctaagcaagttggattaggaatgaatgttgctgcaattgatactattcatacccaaggagcttttcaaagtactcaaaaagcatctgatcttggagttagtggtaatgggttttttattttaaaagaaggtggaaatttgttttatacaagagctggtgcttttgatgtggattctgatcgacatcttgtaaatcctgcaaatggaatgcgaattcaaggctggatggcaagagatttagaaggggaaaaagttataaatacagcttctgatattgaggatttaataattccaatcggagataaagagggagcaaaatctactaaaaacgttacttttgcttgtaatcttgataagagattgcctgtaattcaagaaggtgcaagttcggcagatattgcacgtggaacttgggttgtaaataagtcattgtatgacagctttggaaatgttagtgttcttgagcttagggttgtaaaggatccaaatactcccaatttatggaatgcaacagtgttaataaatggtgagcaaaattcaaatttcacacttgggtttgacaatgaaggagcattagcgtctttaaatgggcagccaagtcaaaaaggagatgttcttcaaatccctataacatttaatgttttaggtgcaaatgtaggtgaagttggtgaacagcaaactgtaaatttgaaattgggaacagttggaagctatactgattcaatcactcagtttgctgatgctagtagcacaaaggctattattcaagatggatatggcatgggatatatggaaaattatgaaattgatcaaaatggtatcatagttggcatttattcaaatggcataaggcgagatcttggcaagattgctcttgcttcttttatgaatcctggaggacttgcaaaatcaggcgatactaattttgtagaaacaagtaattcaggtcaagcgagaataggtgagaccggacttgctggacttggtgatattagatctggtgttttagaaatggctaatgttgatcttgcagagcagtttacagatatgattgtgactcaaagaggatttcaggcaaatgctaagaccattactacttctgatcaattattgcaagaacttgtaagattgaaaaat

SEQ ID NO: 24 - DNA, 1365 bp, Borrelia afzelii
ttgtgcttgaggagattgaaaatgaataaattagaagagcattatatagttcctaaagatgtagttgcagaacttgataagtacataataggtcaagacgaagctaaaaaattagtatcgattgctcttgttaatagatatataaggtctaggcttccaaaagaaataaaagatgaagtaatgcctaaaaacattattatgattgggtcaaccggcattggaaagactgagattgcaagaagactttctaagttaattaaagctccttttattaaagttgaggctacaaaatataccgaggttggttatgttggtcgtgatgttgaatctatggttagagatttgatgggcattgcagttaatatggtaaaagaagagatgtatagtactgtaagagaagatgctttgataaaaacagaggagagaatagttgagagtctttttaaaggatctggcaattctgagaatatagatccaaatgaaataaaggcagaagaaaaggtaaaagagaagcttagaaaaaaacttagagcaggtgagcttgatgatactactattgaaatacaaatttctagtaaaatgccattttccacaatagaaatatttacaggtggtaattttgaagagattgatatgggaattggtggtttattaggcaatatatttgataggaaaaagaaaagagaattgaagattaaaaaggctaaggaaataattttagcagaagaacttgaaaaattagttgatcacgaaaatatttcagatattgcaaaatctaaagtcgaaaatatggggattatttttattgacgagattgataaaatagctgctaagaataggagcggtaatgatgtatctagagaaggcgttcaaagagatattttgccaattattgaaggttccaaagttaatacaaaatatggaatagttgatacttctcatattttgtttattgcagcaggagcatttaatttagccaaaccctctgatttaatacccgagcttcaaggaagatttccaattaaggttgagcttaagagtttaagcatagacgatttgaaaaaaattttaaaacaaacaaaaaattctttaataaagcaatatgttgctatgtttaaggtttataatttggatttaaagtttagcgaagaggctatagatagaattgcagagcttacttttaatatgaatcttgagaatgaaaatcttggcgcaagaagacttcacggcgttatggaaagagtgcttgcagatcttttttttgaggtgcctggtagtaagttgaaaaaatttgaaataaacttggactatgttaataaaaaaatacaaattaacgaacaaaaagatttaaattattatataatt

SEQ ID NO: 25 - DNA, 681 bp, Borrelia afzelii
atgaaaaaaacaataataatagcgcttttatatgggttgatcacaaatatttaccctacaataacatcaacattaaaaccagatgaacaaacaaacgaatatacaatagaaaaactttatcaaaaagcaatgatgctaaaaaaatcaaaaaaatacaacaaagctatagcaaatctaaaaaaaataattaacatggatcaaaatcaagttgatgctcatcttttactctcagaattagaatatttaaataaaaactggaaaaaagcaattattaaatctcaagattatttaaaaataatagactttaaagataaaaaaaactttttagatatatcttgggcatattttttaataggagaagttgaaaattcaatggactacataattaaatttttccaaagcggtaaagaattgttcaaagaaaatatatttatagcaattgatgctctttttaaaaaaagtatttatcattttataaacaatgaagatgtagcatttaatataatattaacctcaacattccaattagcacttaatgacgacactttatttataatttttttaaataatttagaaataataaaacaaatacctttttattattttaatagaaaaaaaattaaagaattgtatctgcaaattaataccctaaaaacaatccaaaacacaagttgtagaact

SEQ ID NO: 26 - DNA, 1137 bp, Borrelia afzelii
atgaatataaagaataaattaatattgatgctgcgcattgtggtgacaatctctcttatcgcatgcaaaacgcctccggaagcaagagagagcaaaaatgctaaaattgcacaaccaaataatgaaatttttcaattaagagatctaaaagacattaaaaatgaactaataagagaaagggggcatcttttttattctaaagagtttaatgaagctgaacgattagaagaagcaatgaagcaaaatttttctaaaaaaaaggcaaaagaaggaaatgaaattgcactaaaagtgcttgaaagatacaaaacaataataaaagaaacaaaagaaaaaaaagaaaaaacaaattaccttaaagaaaatattgaaaagtatctaaacgatgcagaagcaaatgaggcttatatatggattccactggaaatcgacgaagtaaataacttatattttgaggcaacaagaaaatataaaaattacgatcttgacaatgcccttgacatgtatagcaaagcattcaacagagcacaacaagcagcaaaaaatgctaaagaagctaaagccttaaaagaaactgatgagagaatgtataaacaattaaaagcgcttgaagctgcttccaatttaccagtttatagtaataataagcttatcaagccatcaccatggaatggtagagcatttattaaagagagaaacggtcacttaaaccttttaaatattaatgcagaagatacttatttccttggagaaacaaaaacttcaactccaatagtactcgcatatgaagaaaagatggaaatagcaaaaacttctaaccctcaagaacaattcaaaacactagaacttattgaacaatctagaaaattgtgggaaaaaggagttgaggctaaaaatgtcaaaaactttagacttgccaatgaattatttttagaatctgcaagatacctagaagcttatcagagcaacgcaagcagtgagctttatgtaataaaaataggtaatactttgtggggaatttctaaaaaattatacaacgatccttacttatggccaaaaatttggtttgctaacagacaaaaaatacaaaatccagacctgattcattctaactggaaaataataattcctgctaaa

SEQ ID NO: 27 - DNA, 1581 bp, Borrelia afzelii
atgaaattacaaaagttattatttttaataatattttttctaacttttctttgttgtaataaagaggaaaaaaaagaaggagtatcatttaaaataagcctgggagcagaaccaagtagtcttgacccccaattagcagaagacaatgtcggatcaaaaatgatagacacaatgtttaaagggcttattacaggcgatcctaacacaggaggaaacaaaccaggacttgcaaaaagttgggatatttctcctgacggaacagtttacacatttaccctaagagaaaaaatcatctggagtgatggagttgcaatcactgcagaagggattagaaaatcttatcttagaattttaaataaagaaactggctcaaattattctgaaatggttaaatcaaccattaagaatggtcaaaaatattttgacggacaagtgtctgactctgaacttggaattagggcaattgacgaaaaaacattagaaataacactcgaatcaccaaaaccctattttatcgatatgttagtacaccaatcatttattccaataccgattcatattgccgaaaagtatggacaaagctggacaaaccctgagaacatagttaccagcggtccttttaagttaaaagaaagaattcctaacgaaaaatatgtggtcgaaaaaaatgataagtactataactcaaaccaagtagaagtacaagaaattacattttatacaacaaatgataactcaacagcatataaaatgtatgaaaatggggaattagatgcaatctttggcgctatacctcccgatttaattaaagatctaaagttaagaagtgattattactcatcagctgttaatgctttatatttttacgcattcaacacgcacattaaaccactagataatgttaaagttagaaaagccttgactcttgctattgatagagaaacgcttacctataaagttcttgacgatgggactactcctacaagaagaataacccctaacttcagctcatattcttatgcaaaaaatttggaattatttaatcctgaaattgcaaaaacccttctagctgaagctggttaccctaatggcaatggatttcctattttaaaattaaaatataatacaagtgaagctcataaaaaaatttgtgaatttattcaaaaccaatggaaaaaaattttaaacattgatgtggaacttgaaaacgaagaatggacaacttacttaaacactaagtcaaatggaaattacgaaatagcaagagcagggtggataggcgattatgctgatcctttaacatttttaagtatattcacacaaggatacacacaattctcatctcacaattactcaagcccagaatacaacgaacttattaaaaagtctgatcttgaacttgatccaataaaaagacaagatatcctaagaaaagcagaagagataattattgaaaaagattttccaatagccccaatatatatatatggaaatagttatcttttcagaaatgacaagtggacagggtggaataccaatattacagaaagatttgatttatctcaactaaaattaaaaaaa

SEQ ID NO: 28 - DNA, 1623 bp, Borrelia afzelii
atgaattttaataaaactacaaaaatcaatacaaaacttaagctagcaacactaattatacttgccatatctttaattacatgcaacaacaattcggaaaaggaaaaattaacatttaaagtatacatagggggagcaccttcatcacttgatccacacttggtagatgagacaatcggagcaagaattttagaacaagtattctcggggctcttatcattaaatactaaaacaggaaagctaatgcctggacttgctaaaaattgggaagcctcaaaagataaaaaaacatatcaattttacctaagagacaaccttgtttggagcgacggggtttcaatcactgctgaagggataagaaaatcttttttaagaattttaaataaaacaacagaatctgcacatgttgacatgcttaaatcaataataaaaaatgggcaagagtattttgatggaaaagtatctgattctgagcttggaattaaagcaattgatagcaaaacattagaaataacacttacatctccaaaaccctattttcttgaattgctcctacatcatgcattcatgccagtacctattcatgttattgaaaaatataaaggaaattggacaaatcctgaaaacatggttaccagtggtccttttaaattaaaaaaaagattacctaatgaaaaaattatatttgaaaaaaatgaacactattacaatgcaaaagaagtagaacttgaagagcttgtctacattacatctgacaatgatctgactgtatacaatatgtacaaaaataacgaaattgatgctatttttaacagcatcccgccggacattgtaaatgaaataaaactacaaaatgactattatcaacacaaaagtaatgcaatttatttatactcatttaatacaaaaataaaaccccttgatgatgctagagttagagaagctttaacgttagctattgacagagaaactttaacttacaaggtactcaatgacggtacagttcctacaagagaaataactcctgatcttgaaaattacaattatggtaaaaaattagctttatttgatcctgaaaaatctaaaaagcttttaacacaagctggatatcctaatggaaaaggatttccaatgctaacgctaaaatacaatacgaatgaaactcataaaaaaattgctgcatttattcaaaaccaatggaaaaaaattttaaatataaatattatgcttaccaatgaaaattggcctgttcttactaatagtagaaatacaggcaattttgaaataataagaattggacgcattggggaatatttagatccacacacatacttcactatattcacaagcgaaaattcgcaacttgcatcatacagatattcaaacctagaatttgataaactgattagagaatcggattttgaaaaagaccctataaaaagaaaaaaaatacttagaaaagcagaatcaataataattgaaaaagattttcctgccgcaccaatatacatatattctggacactatcttttcagaaacgacaaatggactggatggagtcccaatgtatcagaggtttattatttttctgaattaaaatcaattaagaatgcaaaacacaac

SEQ ID NO: 29 - DNA, 1197 bp, Borrelia afzelii
atggaaggaaatgattttattaaatttgggagttatttgagaaaagttagaaatgataaaaatttaactcttgaaatggtagctgatgatattaaaatttctgttaagtatcttaaagctcttgaagattctaatattgaaattttcccaaatgaagttttggctgttggatttttaaggacttatagcgaatatttagatattgattctagattaatatcgacactttttaaagattataaaaatagacttaatagcagttatatcgggattagatctgaagataaaatttcaaatttaggcttttcaagtgataaaaaagtcccagataaaaaaatatttttttttagtttagagtctttaagtatgttaaaaatccttttaggaatcgctggcgttattttgctattatttatgtttattgcttttagagaagtgaaagtttattttaaaaaattttttaagcttagccgggatgagaagaaaatttctaatattcatgaagtgtcttttgataaaaagaatttttggaatctttctcttagcgaaggagattttttatctttaacatatggtaataatatcgcaaaatatagaacatcgtttattagtgatgatttggttattgttgatgagtctaaaaaaaataaaaatatttttaatttgggagagtttaaagagataaatcttgatgataatttgagagtcaaaattatttatgagaattattattatgataagtcgaaaatagcccatgtaagtttagagtcttttgctttaaatgttaaatatgtgtctgaaactaatattgacaatagatttaatattttaaattggcagtttgatgttaagggaactgaaaaattgccaagtagtgattatcttaccctatattcttctcaaaaactttcaaatgttgatttgaaaattgattttttaaatgatacattttttagatatgctgatgaaaacaatcttcatggcaagtctttttttgcatccaaaggaattcccattaatttagcttttgaaaaatctttaatactatttttttcaagactttctgatgttaatattattctcaatgacagaaacattacttcttttttaaaagagcagggaaaagaaatttttgctgtccaattcttttgggtaaagacaccttcagggtttgatcttaaggtttctgaagtttat

SEQ ID NO: 30 - DNA, 1416 bp, Borrelia afzelii
atgtctttgaattacgttgaaataaatactttgattaaagaaatccctttcacaaactctttaattaaaaaaataatacaaccggattataaaagtttgattttagagatttacaataaaattgaaaataaaaaattaaaaatattaatctctttaaatccaagcactactagattccatataacaaaaaaaaatttcaaaaagaataccttaaaattaagattttctgaattcttaaaatcaaaaattcaaaatggaaaaattataaaagctttccaaatgaaaaatgaaagaatcatttctcttgagattttaaaaaaggacataattatcttatttattaaattgtggccatcttctccaaatataatagctacaaaccaaaactttaaaatactagatgcttattacagaagaccaaaaataaaagaaacaacgggtgaaatctttttaaaagctaaagaaatacatgaaagcaataaaatgtctgataaaaaaataatgggcctaaaagaagaatacaataacgccagtcacacatcttattctgaatttcttgaaaattactacgaatcgctcagcaatcaaattaaagaaaccaatataaaagaattacttattgaaaaatataaaaaagagttaattgttttagaaaaaagaatagaatctttaaaacaacaaatcaaactaattgaaaacattgaaaatgaacgggaaaaaggtgagttaattttattaaatattaacaaaatacaaaaaggacttaaagaaatagacctcttaaattataaagaagaaaaaataaaaatatcgttaaatcaatcattatcaccaaaagaaaatgccttacaatattttaaagcatataaaaaaggcaaaagttcatttaataccatacaaaatcaattaaaagataatctggataaattcaatcttattcaatcaaaaataaccatgttaaaggtcgaaaatttcattaccaaagaagaatataatcaagaagaaactgccattaaaaaaaaagaaaaaacgtcaaaaataggattgcatttcacctcttatggatttgaaattattattggaagaaacgcaaaagaaaacgatgaacttttaagacattgcgttaaaggaaatgactattggcttcatacaagagattatcctggagcttatgtttttattaaaagtcaaaaaaataaaactccttgccttgatgtacttttagctgctggtaatttatgcgtattttatacaaaattagcaaaaaaatcaggaaaagcggatctttactacactcaagttaaaaatttaagaagagttaaaaatggaaagctaggtcttgtaattccaaaagcagaaaaaaatttacatattaagttagatgaaaatctaataaaaaaaataaaaaataaaacc

SEQ ID NO: 31 - DNA, 1797 bp, Borrelia afzelii
atgaaaagagaaatatatgcatttttgagcaactttattgtttttttatgtttttttctaagtttaatctttagttattcttatttttttggagaaaattttttagaaaagcatagattaatagcggctttttttgattctattttggttttttataagtatttttatgggttttttatttttattgtttgcatttattttgctttttttgttcagcaagaaataaagatttatttaaaatcgtataatgggtatttattttctagactttatacatttttactagtattttttattataggacttttttttacctttatatttaatttaatattgccttatataattgcccagagaaatgagtataagtttagttacgatagatataatcttcttgaaagtgaagcaaataaaatatctcttaaaattaaaaatatagatataagtttatcttcaaatagattttttttatcttctgatttgtcagattctatgaagcaaaagagaaaacatcttgaaaatttgattagaatatatgataaaatgcgaattatttatgtaaataatgaagaacttttaacaaactactatttagtaaaatctgaatacagtaaaattccaagctatgacgttgatttagaaaaggttaagaaaactttttcacgatatcctttacaaagccttaaaaagcaagatttttttaatattgtcaatgaatttatttctcaagccgattattatacagctaattattttgcttatattgcttatgttgcaacaaaagatgatagttttgtttcgcttttaaatttgactttaaagtttattaatgaaaacaggaattttgaaaaagaaaaaatgcagttgatttccgaagaaaagcaaaaaaattttttatatcttaatactgaaaaatttaaattagcttattacggtttttcaaaacttcataaactattgcctagtgataatgaaattttgaattataaaaataaatcgcttgaaaagctgagaaaaagatatcttttttttgatgagattgaaaaatattttgaatatttcggaataaacgatgtattgttgttgcaaccagattctaagagaggtttttatgattatatttatatgcaaaaagttgtcacccttaataattattctaaaataataaaaaattttgaacttattagatttaataacacaggaaatgttattttgcatattaaaattccgtttgctaccttaagaggtaattttgtgtatcaaaatgttttagacaaagataatgagcagagcgaaattactcttaccaaagtctttgtgtctaaggatagttttgatacaaacgttttagaggttgtcaagattaatgaaaatgtagaaaatttagctttattttcaaattttactgaggttggattttttttaaaaattcaaagtttgtcaagcgcttttcataaggttactatattaaatttgaaattaattaatattttttccttaactttagttttactcatttctcctattttgctagttttaatgggagcattttttgtttctttgttttctaaaatagaatttaatttcaattctaaggttatgattgttttagtctcattaatgatagctgtcttctctgggattgcttgtctttttgtaaattattttttaattatttttacctctcttcttatatatgtttttaatagtgtgtacatatctttggctatcctttctgtgttattaggttttcttattttcaaaataattattttaaattataaggaaaggcatatt

SEQ ID NO: 32 - DNA, 1428 bp, Borrelia afzelii
atgaaaaataaatttttaataggcgtgtattttttattgactttaggtataagctctctagtaattgttgaatctatttttgcttttgatgaatctaataataataagttatcaagatctagttatgagcagatgatgattcaggcttttgaatttgtaaaagaaaattatgttgatcctgtaagcgatgaagtgatttttgaaggtgctttaaaaggaatatttcaagctttgaatgatccttattctcaatatttgacaaaaaaggatttagaagagatttcgaaaacaacagtgggagattatgtcggtattggaatttctataataaaaaaaatgcattctcaagataagcaagacaaggcaaaagatcttgatcctaatagcgcttgcgtttctattgttacgccttttgaaggaggtccggcttataaggctggaattaaatctggagattgtattaccgctgttgatggcaagagcgtttcttctatggaggtagatcaagttgttgatcttttaaagggtaaagagggtacaaaagttaaagtgtctattcttaggggcaaaaatttaacattggattttgaacttacaagagagaagatagaaatacaaacaatcaagtatgatgttattaatccagatattggttatgtaagaatagtaagctttaatccgcacacttctgcagattttagtaaagctttagataatctcaagaataggaatattaaatctttgattttagatttaagacttaatactgggggatattttcaggcagctataaaaatggcggatgatattttatctaaagggactattgtttctacaaagtcaagaaattctagcaagcctgttgattataaagcaagctcaaaacaagttttaccctcagatataaaaattgttgctttaatagataaatcatcagcatcagcctcagaggtttttgtaggggccttaaaagacaataaaagagcctatattataggcgaaaagtcttatggcaagggacttattcagcatgtagttcctttttatactggtggctttaaaattacaagttcaaagtattatactccatctggaaagagtattcataaaattgggattgagcctgatttggaaataaaatccccagatttttctgaagaggaagcattaatatataaagaaatttttgataaaaagctagtagaaggctttttgaagggtaaaaaatctattactgaacaagagattgatttttttgttgaaaatcttgttaaagaaaatccaaaatataaaattgataaagaatttttaggcaagtatgtgttttttaattattatcaagataataataaagaactgccaatttataatctacattatgacaaggctttaaaagcggcttgtgaatatttatctaaattaggtaat

SEQ ID NO: 33 - DNA, 1374 bp, Borrelia afzelii
atgaaaaagcaaaatccatggatatctttaagcgaagaagaaaaaaatcaaattttcaatttttccgaaaattacaaaaaatttataagtaaatttaaaacagaaagagaagttgcatcctatgccctagataaagcaaaaaaaaagggatttcttaacgctgaagagaaaaaaaatttaatgccgggcgataaaattttttatacctgtagagaaaaaactgttgcttttgctattattggcaaaaatcctattgaaaatggaatgaacttaattgtctctcacacagattcaccaagacttgatgcaaaaccttcgccaatctctgaagagaacgagcttgtatttcttaaaactaactattatgggggaataaaaaagtatcagtggttatctacacccctttcaataagaggtgtgatattcttaaaaaatggagaaaaggttgaaattaatattggtgataatgaaaacgatcctgtatttataattcctgacattttgccccatcttgatagaaaaatacaaaggaataaaaaatcagatgaaattattgaaggggaaaatctaaaaattttaattggaagccttccaatcgaaacaaaagaaaaaaataaagttaaactagcaactctacaattaataaaagaaaaatataaaatagaagaagaagattttgtatcatcagaaattgaaatagtacccgcaggaacagcaaaagacgttggatttgacaaagctttaattggtgcttatggacaagatgacaaaatatgcgtctacacttcactagaatccatatttgatcttgaagagattccaaacaaaacagctatttgctttcttgtggataaagaagaaattggttcaacaggttcaactggattagactcaagatatcttgaatattttgtttctgatatgatctttaaaattaaaaaatcagaatacaataatcttcacgtccaaaaagctttatggaattcaaaaagcatttctgctgatgtttgtgcagcaataaacccactatttagctcagttcatgacgaacaaaatgctcccaaacttggttatggtatacccataatgaaatacacaggacatggtggaaaaagcatggccagcgatgctgatgctgagcttgtttcttatattagacaattattaaataaaaacaatatagcctggcaagtagcaacacttggaaaagtagaagaagggggaggaggaactgttgctaaattcttagctggctatggaataagaacaatagatatgggaccagctgttataagcatgcattctccaatggaaataacttccaaatttgatttatacaatgcttacttggcatacaaagctttctacaaagaa

SEQ ID NO: 34 - DNA, 1053 bp, Borrelia afzelii
ttgaatggtggaaatggagaagcgttttatatgaggattgcaatttttatatttggaattttgttaacttcttgctttagcaagaatggaatagagtctggttcaagtaaaattaagatatctatgttggtagatggtgttcttgatgataaatcttttaattctagtgctaatgaggctttattgcgtttgaaaaaagattttccagaaaatattgaaaaagttttttctagtgctgtttctggagtttattctagctatgtttcagatcttgataatttgaaaatgaatggctcaggattgatttggcttgtagggtatatgcttgcggacgtttctttatcggtttcattggaaaatccagaaattaactatgggataatagatcctatttatggcgacgatgttcagattcctaaaaatttaattggtgttgtttttagaatagagcaaggtgcttttttagctggctatattgcagctaaaaaaagcgtttctagtaaaataggttttataggtggagtaaagggcgatatagtagatgcatttcgttatggttatgaggctggtgcaaagtatgctaataaaggtatagagattgtaagtgaatactctaattctttttctgatattgatattgctagagttatggctaataaaatgtattctaaaggaatagatataattcattttgcagctggtttggcaggagttggtgttattgaggcagcaaaagaacttggtgatggttactatgttattggagctgatcaagatcagtctcatcttgctcctaaaaattttattacttctgttataaaaaacgttggtgatgcattgtatttgattactagcgaatctcttaaaaatgataatgtttgggaaggtggaaaaattgttcaaatgggattaagagatggtgttgttggtttatctaatgcaaatgaatttgaatacataaaagatcttgaaaggcaaataattaataaagagattattgttccttgcaatcaggaaggatatgaaatttttataaaaccaatattaaagtta

SEQ ID NO: 35 - DNA, 4131 bp, Borrelia afzelii
atgaaagagataaaagattttgaaaaaataaaaattaaaatagcatctcctgatcaaattagaaattggtcttatggagaggttaaaaagtctgaaactattaattatagaactttgagacccgagaaggatgggcttttttgtgagaggatttttggtactacaaaggaatgggaatgttattgtggtaaatttaaatcagttagatataaaggcattatttgcgatcgttgtaatgtagaggttacccattttaaggtgaggcgtgagagaatggggcatattgagttagcagctccagttgctcatatttggtattataaatatatcccctctaggattggtcttttgcttgacattacggcatctagtttgaattctattctgtattatgaaaaatatgtggtaattgaaccgggtgatactgatcttaaaaaaatgcagcttttaaatgaagatgagtacatagaggctagagagcgatatgggatgtcttttaatgcttctatgggagctgaagctattaaaagtcttcttgaaaatcttgatcttgatgagctttcatctaagcttagaattcaaatgatagataaagatgataaaactgataagaaactcttaagacgtcttgaaattattgaaaattttaaaatttctggaaataaaccagaatggatgattatggaagttctccctgttatacccccagagattaggccaatggttcagcttgatggaggacgctttgcaacatctgatcttaatgatctttacagaagagttataaataggaataatcgcttaaggaagttgcttcttcttaatgcgccagagattattgtgagaaatgaaaaaagaatgcttcaagaatcggtagactctctttttgacaattctcataaaagaaaggttgttaaaggctcatctagtaggcctcttaagtcgctttccgatgcgttaaaaggtaagcagggaaggtttaggcaaaatcttcttggtaaaagagtagattattctggtcgttctgtgattgttgttggacctgagttaaaactacatcaatgtggattgcctgcgaaaatggctcttgagctgtttaagccttttgtgataagaaggttgattgagagtgaagctgtttttaatattaaaagagcaaagaatttgatcgaacaagaagttgacgaggtatggcaaattttagatcttgttattaaagagcatcctattcttttaaatagggcacctacccttcatagacttggaattcaagcttttgagcctgtgttagttgagggtaaggcaataaaattacatcctcttgtttgtcatgcatataatgctgattttgatggtgatcaaatggcagtacatgtacctcttactccatcagcacaagctgaaagttgggctttaatgctttcaacaaataatcttttaaatcccgctaatgggcatcctattgtttttccatcccaagatattgttttaggtctatattatttaacaatggaaaaaaagaatactgttggagaaggtaaaaagtttttaaactttaataatgttattcttgctataaataataggagtctagattacaatgcttctatttatgtaaaaattgatggcaaatataaaaaaactacagctggtagggttatatttaatgaggccttgcccaacggaattgaatttgtaaataaaactcttagtgatttggaactacaaattttaatatcaaaagtttatgtagttcatggttcttctactgtaattgaaatgcttgacattatcaaggagcttggctttaaatatgctaccaagtttggatgcacaattagtatgagtgatattattgttcctgatgaaaagaaagcttatatagacagggccaataaagagattgctaaaattcaaaatgattatgctaaaggtgttattaccggtgaagagcgttataataacgtagtttctgtttggttaaatacgaacgaggaacttactaataagatgatggaaattttaaagaaagacagagatgggtttaatgttatatatatgatggcagattctggtgctaggggtagtagaaatcaaataaggcaacttgctggcatgagaggattgatggcaaaaacttctggggatattattgagcttccaattatttctaactttaaagaaggtctttctgtgatagagtttttcatctctacaaatggagcgagaaaggggctggcagatactgctcttaagactgctgatgctggatatttaactcgaagattagtagatattgctcaagatgttgttgttagaatagaagattgtgggactataaacggaataaaagttgaaactgtaaaaaatggtgaagaaatattagaatctttgaaagaaaaagctgttgggagctattctattgaaagaataaaaaatccaattactggtgagattgttttagatgcaaatgaagaaatctcagaagctaaaatagaattattagaaaaaattggtattgaaaaacttgtgattagatctgttttaacatgtgaagctgaacacggtgtttgtcaaaaatgttatggtagagacttttcaaagaataagcctgttaacattggcgaggctgtaggaataattgctgctcagtctataggtcagccaggcactcaattaactatgagaacttttcatattggtggagttgctcaggctggtagtgaggatgataaaatatctttaaagaatacttttatacttaatggcatagagggttttaatgttagggttgagaatggaattcttttcacaagaaaaggaactttaaaaataatcaatgttttttatgaagaaaaaattaagaacataaaggaaattaaagtttcagattctcaaagagtaattaaaggaattcctttatttgttaataataagggagtagaaattctctcttcttatattggttatgttaaattaagagacgataaatttttaatagtgtcagaagagcaagaagttttcttgaaagctggtacaaagcttgaaatagaggttggcgaatatgttgaatcgggcaaagttattggtacgtttgatccatttgcagagcctattattgcagaggttaaaggtaaaattaaatttaaggatattattttaggaactactcttaaagaagagataaatactgaaacaggtaatgttgagaaaagaattacagataatgtttttgaatctcttgatcctagaatttttattattgatagtggtggtgtggagatcgcatcttatgtattaccaggcgatgcttatcttcaagttgaagatggtcagaatattaatataggagatattattgcgaaactttctaaaggttctgaaaaaactcaagatattacagggggattgcctcgtgttaatgatctttttgaaacaagaattcctaagaatttaactgaaatggctaaagtaagtggaattgtgcaatttaaatcaattcaaaaaggaaaaagacttattaatattttagatgaatatggggttgagcataagcattatattccagccggcaaacatcttttagttagagatggagatattgttaaggcaggagatatgctttgtgatggtagaattaatcctcatgatgtgcttgaaattttgggtgggattagtttacaagagtttttgttggcagaaattcaagatgtttatcgaaaacagggtgttagcattaatgacaaacatattggtgtgataattaagcaaatgatgaaaaaagttaagattgtagcagttggtgatactaattttgtttatgggcaaaaggtagataagcacactttttatgagcagaatagaaaagttattgaacaaggtggtgagccagcaatagcaagtcccattcttataggagtaaccaagacttctcttaatatagattcttttatttctgcagcttcttttcaggagacaacaaaagtattaacagatgcttctattgctgggaaaatagatgatcttagaggattgaaagaaaatgttgtaattgggcatttgattcctactggaactggcatgggactttataaaaaaatcaaagttagtgaaaatgtcaattctgaagtt

SEQ ID NO: 36 - DNA, 3465 bp, Borrelia afzelii
atgataaaaagagttcatctgggacaaggaagagctgatgagattttagacttacctaacctgatagaaatacaattaaattcttatgaaaaatttttacaacttgataaattaaaaaataaaaaacctttacttaatgaaggccttgagtctgtttttagaaatatatttcccatcaaaagtggaaatggtgacgttgctcttgagtacgaaagatactatatagaaaatgatactcttaattttacagaaaaagaatgtaaaagaaaaggtcaaagttatgaagctgttttaaaagtaagactaaatttgcaatttttgactactggggaaataaggcaaaaagacgtgtacatgggaactattcctttaatgacagaaaggggcacttttattattaatggggctgagagggttattgtttctcagattcatagatccccaggagttgttttttataaagaaaaagatttatattctgctagaataattccctatcgtggttcttggctagaatttgagattgattctaaaaaagattacctttatgtaaagatagatagaaaaaaaagaatactcataactctttttttaagagctttagggcttgatacgagagaaaaaataatagaaactttttataatattaaaaaaattaaagttgaagagggtacaaaaagagatcttccaggtcaatatttagctaagagtattaacataagagagaatatgtattatcgagcaggagataagattactctacaagatgttgaagattttttacaaaatggagtaaatgaaatagagcttgttgattttgatggctataatgatgtttctggaaagtactttgtaagttcgaatgttattttaaattgccttgagaaagaggatgctttttttgctttaaaggatggctctaaagagcttccaaaagaatcagtcatgcttgctgtttatggggctcttttccctggcgagccaatatcgattgataatgctgaaaacgatttaaaaaccatattcttttctgaaagaagatatgatcttggacgtgtagggcgctataaactttctaaaaaatttggatctgacgatttaagtacatcagttttaactatggatgatattgttaacaccatatctcatcttttgagaatatatgaagggcatgatattcttgatgatattgaccatttgggaaatagaagagtgcgttctgttggcgagcttcttaccaatatatataaaggagcaatgtcgagagttgaaaaaattgctaaagatagaatgtctaacaaagaagtttttaatctaaaacctcaagaattaataagcgttaaacccattgtatctgctgttaaagaattttttgcaaccagccagctttctcagttcatggatcaggtcaatcctttagccgaacttactcacaaaaggcgtcttaatgctcttggtccggggggactttcaagagatagagcaggatttgaagtaagagatgtacattatactcattatggtagaatgtgtcctattgaaactcctgaaggaccaaatattggacttattgtttctttagctacttattccagagttaatgattatgggtttttagaaaccccctataggaaagttgttaatggagaagtgactaatgaattagaatatttatctgctattgacgaagagaaaaagtgtattgctcaagccaatgctgtttttaattctgatggaaagtatcttgaagatttggtttctgttagaatttctggtgattataccacaacaaaccctaaaaatatagattatatggacgtttctcctagacaattaatctcagtatcttcggcattaattccttttcttgagcacaatgatgcaaatagagctcttatgggctctaatatgcaaagacaagcagtgcctctgcttttccccaaacccccaattgttggtactggcatggaaagtgttgttgcaaaggattcaggagtagtagttaaggctaaaagaagtggggaagttattcttgcaacaagtaataaaatagttgtcaaaccttttgaatcagagaatgctaaagatttagatgaatatcatattgttaagtatgaaaggacaaatcaagatacttgttttaatcaatctgttttagttaaagaggggcaaaaggttgaaaggggtgaaataatagctgacggtcctgctactagatatggggagcttgctcttggcaataatttattactgggagttattccttggaatggatttaattatgaggatgctatattgatttctgatagaattgtaaaggaagatctttatacatctattcatattaaagaattcagtatagaagtaagagaaactaagcttggtcctgagaaagttacaggagacatacctaatgttagcgaaaagatactaaataaattggatgaaaatgggattatacggataggaacttatgtaaagcctggggatattttggttggcaaggttactccaaagtcagaaggagacattactcctgaatttaggcttttaacttccatttttggggaaaaagcaaaagatgttaaaaataattcgttaaaagttcctcatggtactgaaggtacagttattgatgttcaaagaattactaaagaggatgttggcaatctttctcctggagttgaggagatacttaaagtttatgttgctaaaaaaaggaagcttaaagagggtgataaaatggctggacgacatggtaataagggtgttgttgcaaaaattcttcctgttgaagatatgccttatcttgcagacggaacccctcttgacatatgcttaaatcctttgggagttccgtctagaatgaatattggacaattaatggaatcgcaattaggtcttgctggtaaatatcttagtgaatcttataatgttcctgtttttgaatctgctacaaatgaacaaattcaggaaaaattaaaaaaagctgggtttaatccaacttctaaagaaattttatatgatggttatacaggagagcctttcgaaaatgaagtaatggttggagtgatttacatgcttaagctacatcaccttgttgatgataaaatgcatgcaagatcaacagggccatattctcttgtttctcaacaacctcttggaggaaaagctcaatttggtgggcaaagacttggagaaatggaggtttgggctcttgaagcttatggtgcggctcacacacttcaagaacttttaacagttaaatccgatgatatgtcgggcagagtcaagatatatgaaaatatagtaaaaggtgttcctactaatgtatcagggattcccgagtcttttaatgtgctaatgcaagagcttagggggcttggacttgatttgtcaatttatgatgataatgggaatcaagttcctttgacagaaaaagaggaagaattgattaataaaagc

SEQ ID NO: 37 - DNA, 1047 bp, Borrelia afzelii
atggaaaaggtatttaaaataaaaatgttaaaaaaaatttgcttttgcttgttatttttgcaagcacaaatggttctttcccaagatcaacaagacttagacttcaatgatcaatatttttactttaattttcaatctgcttattaccctccccacgagatgggaacaaatggaaaaagtttttcacaaagctttaaacatcccaacttccaaaatattgaaccaagtttaaaaattccagctaattattggggaggaataaaattaatatcatacttggggtactataaaaatttcaaagctttacacaatcccaattctatattttttaaaaacaatggtatagacgtcgatttaaatatcggactatctcctgtaagcatctcatttaaaagcatgctaagctttactcctattgcttttttaaatttatatgtatcaaatgaaattggtatgggttgggaagcttttggatttaaggggattggtgtacacattgaaaacggaaaatattcaaatactcctgaattttattcagaaataacaatagggggacgatttcaattcgacttaaacgctatttttcaaggagactggacacatattattacagttatcggcaatgattttacatacttaattaatcttcacgcaaacaaaaatcaactttggaaatataaagcagacgatggtaaaaatataaatggtatgctaataaaaccttatgcccttttagcttacaaaatgccaatacctcttaatactataggcctactttatgaaggaaaaacacaaattggtaaagaaagaaacataagctcatggaaaaacaaaggttggggaagtgacattttttatcacaatatttctattgttgctaattttgaaattgccaagcctttaacaattggccttaaattaaaattatccacaaatcccacatacacaagcaatacagctggactggctgatatttcaaaaagaatagcaactggcaattcttatttttattacgattctattggaatctctgtaactcataaatac

SEQ ID NO: 38 - DNA, 4479 bp, Borrelia afzelii
atgaaaaaagcaaactttttaagtaccaattttttaattttgcttttggtttgctttgtcaatggcaatttattttctaaggatatttttaagtttaaacttgtagatcaatattttcctttttactataagaataataaaggagaatatgtagggcttattttttctattttagataaatgggcaaaagataataatgttgatattatagttgaacccattggtaatttaaatgaaagtaaaattgaagatgaagcaatatatttagggttgacttataattcaaaattaaatgatttattttattttaaaagtgagcttgccaggagtatttcgattttattttctaaaagctctaatataaaatataaaaatacccattcaacatttttatcaaactttaatataggggttgttaaaagtacaatatatgaagatatcttaagactaagaggtgctaatgcaatttttttggctgataatgttcaagagttattattggctttaaaaaatgataaagttgattatatatatggtgattgtaagactttacattatattgcacagcggtttttaggtgaagatcttgctatctttagcggagattttttttatagtatcaaaaatagggtggctattagtagaaatgctcctgagataataaagaatttgaatttagatttgttttcatatttaatgaaaatgcctgatgaatatgttgtttcttttttagatagaacttctaagggaaattttattgatgttggtttatataacgattatccccctttgagttttattaattcaaagggggagttgtctggtattttagtggatttatggaatcttctctcaagacagcatatttttaaacctattttcaagggatttcctaaagaggatattaagaaaacattagatggaaagtcagttggaatttttggaggaattattagcaatgatagcgtatttgaaaatgttaattatgtagtaagtaagccaatatatcctcttaattttaaattttattctaaaggtttaaacaataatgttggtccaataaattctcagtttattgattttaattttaataatattcaattaaataagaatcaagatattgttaataattttatagatattgtaaataattcatatgggtttatagaaaattcaataacagcaaaatatttattaaaattaaatggatataacggtagattaaaatcttacgattcgatttttaataaaaataggtttttagtattagctattgataacagggtttataaggttattaaatatattcttaatgctatatttgatgatatttcaattgaatctttacttcaaatagataaaaattggttagataaagaagagattaatagctctcgaataaatagttataaaattatgaataaggttaaatttaatatagaagaaaaaatttggttattagaaaataataaattaaatcttgctgttaaaaattggtatccaatagattatgttgaagcaaataattataaaggaataaatcaatttttgcttgataagattagaatgttttcgggtttagaatttaacataattgaaacatctagtagtttagatctaaaaaaattaattaaatctggaaaaatcgatatgctcaatactaatacgatcgattcaaatttagataatgttttcaatataaaattgaattctagaattccactttatattttttcaaataaaaaaagggtgcttccatctagatctttagagaggtttgctatacttgattttttatatagtaaaaatttggcttctaatattaaatcaaagcttgttctggtaaatagctttaaagaagccttacttcttctttacaagggaaatatagatggaattattagtgatgagtatacagctgcagctgtttttgaagaattaaatgttgtcgatgttgaaaaacttcctatttttagagatttggcttttgatttgagtcttgctatttatgatcaggattatatcttgaaagaaattattcaaaaagttgttatgcgttcaaatgttgatggtcagagatatttgaatgattggaaatttgatgtttattataagtccaaaggcattaggtttaaaaattttaaatttttagtgttaacagttattatattttattttacttttttaggatttgtaataatttttatgttcaaattatcatttgagcagaaaagaagatattcttttgtaatgaatgaaaaaaagatcgcagaagctgctaatgctgctaaaaccatttttatagcgaatgttagtcatgatattcgtacccccattaatggaataattgcggctactgagcttttggatacaactattcttacggatgtccaaaaagactatgttaggatgataaattattcatctgattctttactttctttaattgatgatatattgtatttgtcccaaataaatgtcaatgaattacatgttgagagtcaacagattgatttagagcgtgaaatggaaatggttttaaaaacttttcaatctcaatgtgcaaagaaaaatattgatttattttcttattctaaatctgtttttaataattatataaaaggtgacattgtaaaaattaaacaagttttaattaatttaataggaaatgcttttaagtttacagatgatggtgttattgttttaaactatgaagaagtatacagaacaagagttaatggtaatagattggttacagttgaattcaaggtaatagatacaggaaaaggcattaaaagagaaaatctttctaagatatttgaaatattcaagcaagaggatgattcttcttcaagggttcatgagggtgtgggattaggattgtcaatatctagagaacttataagactaatgggtggtcttggcattgctgttgatagtaaagtgggagagggtacgactttttcatttatgttgccttttttcttgggcagtgagcttaaaagtaaaaatttatcaatcaatagattccaatcaataaatagtaatagtaaagtattaaatgtactcttgagtaaaaaatctattaaaatttttgagcactgttcgactttgttaggccactcttctaatgtgcactatgtagcgtcttttgaggatgcttataaattttttaagaaatattctttttataattttgtttgtgtaaatgtaaataacgataatattgaagagagtattcgatttgctaataatattgaaagattaagttctgatgtacaaattatttttttattttattgcttagataataaagctctaaaaaatttaaaatatgtgtatgttaaaaagcctttaacagggcttggtatatcttctattctttctaaaaaagagtttgaaacagaggtagattttgaaaatttggctccaatagatagtgcttttaaggtaaaagaacccattagtgtgttaatagctgaagataatcaagtgaatcaaaaagtgctgaaagacattcttattgtaataggtattaatgaaaattttattgatattgtagatgatggagtaaaggctttaaaagctttaaaagaaaaaaaatatgctatctcttttattgatataagaatgccaagatatgatggattttcagtggctaaagaaattagaaaatttgaaaaggcaaagaatttaaagccatgtgttttagttgctgtaacagcacatgctttgcaagagtataaagatgattgttttaaaagtggtatgaatgattatatctcaaaaccaatacacataagttcaattaaaggcatattaaaaaaatatttacagtttgaagttgatgatattgggaagaatgaagatttaagccaacttgttaagttccccaatttagatgttaatagagctttaaaagaattaaatctttcatatacatcatattctgaattatgtagaggacttgttgatttcatctctatcaatattattgatttagaaaaagcttttgatgaggaaaatttgtctttaattagggacatatctcattcaatatctggagctctttctaatatgcgtagtgcattgtataaagattttaaaaaaattgaaacaagtaaagattcaatttatgagttgaaaaaaatgtattcttttataaaagatgatttattgcgactaataagcaacataaaggagaatgttttgtttgagtctgagattgttagtgagaataagctttactttaaaaacaatgatcaatttttaaaccttctcaataaacttttaattggcattaagactagaaagccaagagaatacaagggaattcttaagagcattgacaaatatgttttagacgataatattcaagtattatttagtgatcttcgcaagaatttaagattatatagatttgacgagagctccaagattcttaaagagattattgaaaagtttagcaataagagatat

SEQ ID NO: 39 - DNA, 780 bp, Borrelia afzelii
atggacggagtttttaaaatgatagatattcaacttttagatattgataatgatcagccaaggaaatctgttagtcttgttgaattagaagagttgagtatttctataaaggaaaatggaattttgcaacccataattgtttgtaaagtaaatgagaggtataaaataatagtaggagaaagaagatttagggctgccaaacttattcagatgacaaatattcctgttattgaagttaatataaaagaatcttgtagagattttatgcctttggttgaaaatatacaaagagaaaattttacgcctgttgaggaagcttatgcctataaaaatgtaatgaataaatattctttaactcaaaaggatttgtctgaaaaaattggcaaaagtagaacctatatttcaaatatagttaggattttagaccttgaacaagaaatattaaatgcagtgcatagaaaagaaatttcttttgggcatgctaaagttattttatccttaaaagacaaacaagataggtataatctttatttaattatactgaaaaaaaaattttctgtaagagacgcagaaaaatatgttaaaaatttttataaatctataacaaaaaaaaaagaagtcgaacaagatccttttttaagtaacataaaagaatttttatttgataaaattcaaacaaaaatagatattaaagggaatcaagataaagggaaaatagaaatagagtattttacagcaggcgatttaagaagaattgtttccttttttggccatatcaac

SEQ ID NO: 40 - DNA, 1917 bp, Borrelia afzelii
atgaatggaaggtttatgaattatgttgctagtaacattcaggttttaaaaggacttgaggctgttaggaaaaggcctggcatgtatataggctctgtttctgttaatgggttgcatcatttggtttatgaggtgattgacaatagtattgatgaggctttagctgggttttgcgatagaatagatgttattattaatttagataatactataactgtaattgataatgggagagggattcctacggatattcatgaagaagagggaattagtgctcttgaacttgttttaacaaagctacattctggtggtaagtttaataaaggcacttataaagtttctggaggattacatggtgttggaatttcggttgtaaatgctttgtcttcgtttttagaagtttatattaatagggatggaaaaatttttaggcaaaccttttcaaaaggtattccaacttctaaagtagaagttgtgggagaatcttctattacgggaactaaggttacttttttagcagattctgaaatttttgaaactttagattataattttgatgttcttgaaaaaaggcttaaagagcttgcttttttaaacgataaaatatgcatttcaattgaagataaaagatttggtaaagaaaaatcttcaaaattttattttgaaggtggtataaaatcttttgtagattatttaactaatgacagtaaagcttatcaatcagaatcttattatattgatggcttaataaatgatgttattgttaatgtaggacttaaatggactgagagttattctgacaatattctttcttttgttaataatattaatacaagagaaggggggacccatgttatgggttttagaagtggccttactaaggctatgaacgaagcttttaaaaattcaaaaataagtaaaaaagatgttccaaatcttacaggggatgattttaaagaagggcttacagctgttatttctgttaaagttccagaacctcaatttgaaggtcaaacaaagagtaagcttggtaattctgagataaaaaaaatagttgagattattgtatacgagcatttattgaaaattattaatttaaatcctttagagatagaccttattcttggaaaagcaataaaagctgcgcgtgctcgtgaggctgcaagaaaagcaagagaatcagaaagaaaaaaaaatgcatttgaaagcttagcattgcccgggaaattggctgattgtacttctaaaaatcccttggaaagagagatttatattgtagaaggtgattctgctggaggaagcgctaaaatgggcagaaatagattttttcaagctattttgccattatggggcaaaatgcttaatgttgagaaaacaagagaagataaggtaattaccaatgataagcttattcctataattgcatctcttggtgcaggagttggcaaaacttttgatattacaaaacttcgttatcacaagatcattattatggcagatgctgatgttgatgggtctcatattagaactttgcttttagcttttttctttagatatatgagagaattaattgaaaatggctatatatatatagcaatgcctcctctttataaaataaagtatgacaatcgtatttattatttttatgacgagaaagaaaaagaaaaatttttaaattctattgagactaaaaatcgcaatagtatccttttgcaaagatataaaggacttggggagatgaatccaactcagctttgggaaacgactatggatcctgctagaagaaaaatgagattgatgaatatagatgacgctgttgaggctgaaaaaatttttgttactcttatgggggatttagttgagcctagaaaagaatttattgaacagaatgcacttaatgtaattaatcttgatgtg

SEQ ID NO: 41 - DNA, 1758 bp, Borrelia afzelii
atgtttaaagttattaaatgtaatgaattaaatgaaaaattgataaacaaaaaagttgaaataaatgcttgggtaaaaaaaattagacaccacggaaaatttacctttctagacataagagacagatatgaaaaagctcaggttctgataactgaagaacaccttctaaagatagtagaaaaaataaaacttgaatattgcattaaaattcaaggattattgattaaaaggccttccaacatgataaatgcaaatatgacaacagggtattttgaaatattggcaaaaaatattgaaattatctcaaagtgtaatgaattgccatttatgatagaagatgacaataatgcaagtgaaaactcaaaacttaaatatagatacttagatttaagaagagattcattgaagaataaaatcattttaagatgccaagctactcatctaattagaaattttttagtaaaaagaaaatttttagaactagaaactccaacttttgtaaaatcaacaccagaaggcgcaagagactttgtaatcccatcaagaattcataaaggatctttttatgctttacctcaatctccacaactttataaacaacttataatgatagcgggatttgataaatactttcaaatagcccgttgctatagagacgaagattcaagaggagatagacagccggaattcactcagctcgatctcgaaatgagttttgtcaaaaaagaaaatatttttaaattaatagaaaatatgcttttttcaatatttaaaaattgccttaatattaaattacctaaaaaattcaaaaaaataacatacaaaatggcaatgaacaaatatggaagcgataaaccagatactagatttgaacttacattacaagatataagtcgcaatctaaaaaattcagaattcaatgtatttaaagatattctaaacaataaaggttcaattaaaactttgatagtaaaagataaagctgatacgttttcaagagcaaaaataaataatttagaagaaattgcaaagctttacaaaacacaaggactttatttcacaaaaattgaaaacaataaattttctggaggaattgcaaaatttttaaaaacagaagaacagcaattaataaaagcctattctctagaaaataatgacataattttctttatagctaataacaaatgggaaattgcttgcaaagcaatgggtcaaattagaataaaaattgcaaacgatcttggactaatagatgaaaataaatttgaatttctatgggtctacgactttccactatttgaatatgatgaaaatacaaaaacttatataccagctcaccacatgttctcgattcccaaaaagcgatatatttctaatttagaaaaaaatccaaacaaagctataggagaaatttacgatcttgttttaaatggcgtagaacttggttcaggttcaattagaatacataacaaagaacttcaacaaagaatttttaacataataggatttcaaaaagaaaaatcagaagatagatttggattttttctaaaagcattagaatatggagctcccaatcatggcggcattgcaattggtattgatagactaataatgctaatgacaaaatcaacttcaataaaagatgtaatactatttcccaaaaattcttttgcagcaagtcctcttgacaactccccttctaaaatctcaaatgaacaactcaaagaactgggaatcaatattgctgcagatgatact

SEQ ID NO: 42 - DNA, 687 bp, Borrelia afzelii
gtgaaaacaatagatcatgaactttattatgaatttaggatagcggatgatgttaaaatgatttatactaaaaaaccttttcatctaaatttaaaagaacttagtaatgataatttaaactttgttcctaagtcaaagaaaataaaatatttaaaacaattacacacagatattatttatgaagttaaagatgattttataaattttcaagaaggagatggtcttatatctagttctttagatgtagctcttgttacttactttgcagattgtcttccaatttacttttatgactcagtaaaaaaaattataggacttattcacagtggatataaaggaagctttagcttgattattttaaaaatgttgtttatgtttgaaaaaatgggatcatcttttaaagatttaaaaattgtttttggaccttataacagatcttgttgttatgaagtttctgaaattttcttgaaagaagtaagtaataaatttagcaaaagtttattaaatacggctttttccataagagataataaaatatactttgataatgctagttttaattttaatttactttctagttttaatttaaatatttatagttcaaaactttgtacgtattgctctaagaatctttattcttatagaagattaagagaggggcaaagttatgctttaatttggagaatt

SEQ ID NO: 43 - DNA, 1281 bp, Borrelia afzelii
atgcatagttatattgtagaaggcggttttaagataggtggtcaaattacagctagtggtaataagaattctgccttgccttgtattttggctgctttgcttaccgatgaagatgttattttagaaaatattcccaatattaatgatgtgaaagttgttttagatattttaagtgatataggagcagatattgtaagagagggtaatactttaaaaataaaagttttagatattgtaaaaaccgaaatagattcctcttttacagatttaattagggcttccatccttttattaggaccttttgtttctagatttggaaaaatagatatggcgcttccaggaggagatgtgattggaaagaggcggcttgatactcatttttacggtctttgtaagctgggggctaagttaagtataaaagatgaaaggattgttttaaaggccaacaagcttgttggagctgaaatgtttttagatgaagcttctgttacagccacagaaaatatcattatggctgcggttcttgctgaagggaatactgttattatgaacgctgcttgtgagccacatgttcaagatttatgtaatatgctaaattcaatgggtgctaatattttggggattggttcaaatgttttagaaataaagggtgtaaaaaaattaagtggaaccatatttagaataggagccgattttatgcaagttggttctttaattagccttgctgcattaacaggaggcgagctggaaattaaaaaagcagatccccagcatttcagattaattaggcatatatattcaaaacttggtattaattttgaatatgatagggaaaatgtatatgtaagagataaacaagaattaaaagtcaaattagattttggtggacaaattccaaaaattgatgatggtccgtggccagcctttccaacagaccttatgagtattattatagttactgcaactcaagtagaaggcacggttcttgtttttgagaagatgtttgaatctaggatgttttttgtagataagttaataaaaatgggggctagaattgtactttgtgatccacaccgtgtagtagttacaggtaaagctccacttaaaggtagcgttttatcttctccggatgtaagggcaggaatggctcttcttattgctgcttttgttgctgaaggtcgcagtgagatccaaaatgtttatcaaattgaaaggggatacgaagatgtagctagcaaattaattaatttgggtgcaaaaatcaagagagttaaaagtcaa

SEQ ID NO: 44 - DNA, 627 bp, Borrelia afzelii
atggaaagaaaagttttttctaaagatgggaaagagattaggactataaatttggatgatagagtttttaatatagaaattagtcatgggtctatttataatgctataaaaaatgagttatctaatcttagggttggtacatcttcaactaaaaccagatcagaggttaggggtagttctaaaaagccttggaagcaaaaaggaaccggcagggctagagtgggcacaaagcgaaatccagtgtggattggtggaggtatagcattagggccaaaacccagagattatagttatagattgcctaaaaaggtaaaaaggcttgcatttaagtctgtattaagtttacgcgcttctgatgaaaataattttaaggttattgagaattttaatattgaatcaggaaaaacaaaagatcttgctttaataataaaaaattttgcaagttttaatggtaaagtggttattcttttgggcaatgatgatcagatgatcaaaagggctggtaaaaatataagagatttaaagattttgtcttttgataaacttagagttgttgatttgttttacgctaagaatttaatagccctagaatctgctgttaacaagcttaatgagttttacgtcaaa

SEQ ID NO: 45 - DNA, 6486 bp, Borrelia afzelii
atgatagattttgcgactattttagttaacctttttttggtttcaatagttttgtttgtttataggcaatatgataaacgttctagagctttagataaaattaaaaagttcattgaccttacaaaggttaatcttgaagattttattgaagataagacaaaagagattaatgatcttgctgttgatatggaagcttatcaaagatctagcatagaaataataaaaaagattgaggaagttcagcaaaagattaaaaacaaaagcaatgattttgcagaggttgaaaaaaagatagcttatcatgattctatgcttaaggatcttgatgagatgacctttaaagttcaagagaatatagaaagattgcaagttgatgggaaaatagtagataaactttcaaaaactttaaaaggatttaatactcaaattgattcggttgaatcaaatttaaattcggtgttagaaaaatttgacaagaccaataaggaaaatctcgagtctattaaaattgctagttgggaaaagtttgatactaatattaaagaccttgtttttaaaatggacaatttgaataaagagattgatctttatgaaaaagatttagcaaatattgaagagagaaaaaaggatattttagttaagggtaatgagaaattagatttagaatttaacgattttcttgaaaaagttgaatttaatattgttaaatataataaagagatagaaaattcttttggtttttatgaagacaaatataagttaatagaaaattctatagagcttattatggagagcgtaaagaataaaattaatgagaaagaagattttattttaaatagactaaatgaagaattgcaaaataaatttaaggatatctttacatacgttgatgatcgttctaaggaaattcaagataaacttgaggataagttgattttagtagatgatgaaatttcttctatgagctcttcttttaaggacaatgtttattcaagaattaattcacttgaagaatcaatacgaatagagatgggaaaatatgaggagcaggttgatgatgtttttgataaatttagatctcaagttgaattaaatcttaaaaatatttatgaagattatgaagataaaataaaccaagttgataagaacattaaagaaagggtagaacttagtttgttagatttgaattctaaaatggaaagcgttcaagtaggtgctatcgatcttatgaagaggcttgaagatgattctaataaaatatatcttgaatttaaaaataagtttgaagaagatattaaagtatttagtggaagttttaaggatgatattaatcaacttaaaatgcaattagaatctcaacttttagatgttgattcaaatattcaagacaagcttattaagcttaatgataatttgatttctaattttgaagaaattggtggcaaatttaataataattattcaaatttaagtgatagtataaatgctaagtacacagctctttttgaatctttggattctagcagctctaaatttgaagatcaaatggaatctaaatataaagtctttacagataaattaacggcagaaatggatgatttttctttaatttatggtaaaaaatttgacacattctctcaagaagcgattaataattatcaagaatttcaagatttaaacaaaaaattagaaaatgaaattggatctttgtgtaatatgttagaagaaaaccaagagattttaaagcgagattttaatactagtttaattaacattaaagatgaaattggtaaaaatataatagagtttaaggatcgttattacgatgaggtaaatatttttgttagtcagctagaagaaagtaagctccaatattcaaagtggcaaagtgaaatggattctaatttaaaaaatattgaatctcaaataaataaaacaaatgaagaatttttaagtttaattcagattcaaaaagacaaaggaatagagcttagtgagagtgtttttaatgatctttctgatcatattcaaaaaaaagctattgatatgcatggtagttggaaagatgagcttattgctttaaataaatctttgcttgatattaagatctctagtgaagagctactttcatctgctactttaaaaatagaaaatctagaaaaagatattaacgatagaatggaatatgttttgttaaaaacaggtgatattgagagtttagttatagaaaaatataaagaattaaaggatatgtcatattcacaaagtgatgaagctatattagaaattaaagaatttattaatagacaaacagaaataattaaagataaaagtgtatttatgcttgaggatttaaacaaaaaatttgatgataagaataattttgttataagtaagattgaagaatgtgattataaattaaaagatttcaagattgaatcagaagatgttttaaataattttaaatctgatcttaatgaatttattgagtcaaaactacaaattgtctctgatataaaatcagacaatcaaaagcaaattgatgattttttagatagaatttccaaagatattttaaataggaaagattcaattaacaatgaagtagacattaagcttagtgattggcaaagcaaattaaacgaaataactgttaaaattgaaaatttattgtcttcaggcaaggtagatttggatttaatagattctgaagtaactacaaaaatcaaagagcttaaattttccatagaaagtcttgagagttattatcttgagaaaatagatgaatttagaaatcagggtgctatatattctgatgagcttttacaggatataatgaaccattttaataaagagactagagaacttgaggaaaatttgtcaaaaaagtttgctgtagttttaaataattcagaggaatttgttaaagaggttgatagtttattgcaggataaaagaactgatattgcttcttttcaggctaatatagatattactcttgattctcttagtgtaaagtttaatgatataaacaaagaaattaatgaaaaatataatgaagtgatatctaattacagagggtattcagaaaatatttctagcaaacttgaaaatgaaataatgcatgagattgaaaatctaaatagaagattaacagatagaatggatagtcttagcaaaggtatggatgaaaatcttcaaaaacttaaggaatcttttgatgtgtcaaaatatcaggttgaaaaatttgaattgaaagttaaagatctaacagatgatggagagacaaaaattagtgagtttgttaaagagatcgaacagtattataaatctagattagaagaagcaattgattataggagaactattgatagtgatattatgcaagcaaaagagagatttggagagataacaaatgatcttaaaaataatattgagagtaaatctgagtttttaaatgatctttataaggaaagatttaaacttattgagagtaattttgaagagagatattctacatttttaattgaaagtgagggagctatttcaaaaattagagatgagatctataaaacacttacaattaatgatgaaaatttgcagattaagattgctgaaatggatcataattttgagataatagaacaaagatcaaaagatattttagagtttgaaaaagaattgcgagataaaattcaggattgttacggtgttataaattctcaatttggagagattaaggtaagtgttgaagaggatataaaaaatcattttgaagtttgtataaaaaaggcaaacactttgattgatgatgacattataaagtatgaaaatgaaattcataagagaattgattctttaaaatcaattgaaaatacttttgatagcatagagaaaaatttgaatgacaaagtgaatgggtgtattgataaaatagccaatgattttaatcttaagtatattgaacttgaagaaaggtgcaatgaagggcaattgaatttagaaagtaaaattgacaacaaaattaaagccattgataatttagcttcaagtcaatatgatgggcttgagaaaaagtatgctgatatgtatgatgaatttttagagagattaaattcttatattacaactttaagtgaagagtttaagcattcaaataaagagatgatttttgaacttgaatctcaattaaaaaatcttaaaaatcttgagtctgatttaaataatgttgaaaaggatgttattagattaaaagaagagtcttatcacaatgtttcatcacatcttaaactattagaagaagatttttttaaagatttgaaaattagaggcgaagagcttaaatattctttggaaaactttgttgcttcatataatgataaaattcaaaatttagaatatgatttgtctaaaaatttggaaaacaagacagaacttattcaaagctttcacttagatattgaacaaaaaatgaaaaatgataaagaaaatttttatttggattttactaaggaattttcttccaaaaaaaaagatatggagagtgagatagctttaatggaaaccaatattactgggagagtagatgaatttattgattttgtaaataacaggcaaaatattattgattcttggtttttaaatattaaagatgatgtaaaaaattggcaagaaaaatcttatagcacaatagagaagaaaataaatcttgctgaacttggaattaaatcatttgagaatgatattcttaatgttaaaattggtttagaatcttttaaagatggttttgaagttaaggctgaagagatttttagcaatttgcaaagcgaggctaaaaaaattgaacaatcagttcatcttgattttaaaaatattggtgaatcattaaatcttaaagttttagatcttgaaagatttgttgattttaaagtagaaaagatagacgaaaaggttaataagaaaactgaagatatcttgactcaggcagaagtgaaatttttaactcagcaaaagaatcttgaagataggatttttgagcttaatcaaaaattggagcaagaatttacaactttatcttctaatcttgataaagtaaggcgggaaatggttgatgtaatttctagtgataaagaaagctttgaaggtcaaattgaattaatgcataaaaatatttcagaattttctgaaaaaattagtttatacagaagtaatattgagacatcaattgagaatgaatatagttctttttctaaatctataaaatcagagttcggtttacttgaggacgagcttaaaaaaagtttaaaacattcaacgttggagattgaatccgtaaagaatgacttacaagaacaaattgataagtttgaggttgaattcaaaaaaaatcataaagaattattaaaagaagttgatactaatgttttagaacttgaatctaaaatattaaattgtgatattacatttaataaatttattagtgacattaaagacaatctggttgaatataaatccgatttgagaaaagaatttgaagatagttatgataaattaaattttcaaattgaaaattttaaaaaactagatgctgagcttgaaaaaaataattcaatatttttagaggcctattctcttaaggataagttagagaaattatgggaaactttaaaaaatgagatagatcttgctcaggaatataaaaataattttgaaaacgttaacaaagaattctataatattcaaaaagaaacattaggtattattgaaacctttaatgatttaaagttagaacatgaatctattcaagctattaagaatgatttaaataaattttttgaattttattcttcatttgatagtagatataagagtttagttgaatcttatgatgaaatgcaaatttataaagctaaaataaaagagatatctgttgagcagagaaccattcttgataattatgaaagaattagcaacaaagagagtatattaaagagtactatagagtccgttgataaaaactttgatttaataaatgaagtggagaaaagatttaatactttaagtaaagagagcactaagtttcagaacaatcttaaagacatggaaaatgttgtttctaatctcttattaaacaaagggttgtctgaagaagtgctggttaatgctcagaatttaaaggaaatgctcttagatattgaaaataggttgaaaaacactttaactatgagagagaaggtggtgaaatctgagacaaggttagagaatttaaatattgcagcagaagagagaataaaaactcttggcattcttgtcaaaacagattctaaatatcaagataatgttggtcttaataatgaaactgttaggaattctgtaataaaattaatgaggcaaggatggagcgctgaagaaatttctagagctactaaattatctattggagaagttgagcttattttagaacttggtataagcaacaagggtgat

SEQ ID NO: 46 - DNA, 1905 bp, Borrelia afzelii
atgggcaaaataataggtattgacctaggcacaacaaattcatgcgtagctataatggagcatggaaaaccagtcgtaatacaaaattcagagggaggaagaactactccatctattgttgcctacacaaataaaggcgaaaggcttgtggggcaagtcgcaaaaaaccaaatggttacaaaccccgaaaacacaatttattctattaaaagatttatgggaagaagatttgaagaggttgcaagcgaaataaaaatggttccttataaaatagaaaagggactaaatggcgatgcacgagtaaacatttctaatataaaaaagcaaatgtcgccgcctgagatctcagcagcaactcttacaaaaatgaaagaaacagcagaagcttacttaggtgaaaaagttacagaagctgtcattacagttcctgcttactttaacgatgctcaaagacaagctacaaaagatgctggtaaaatagcaggccttgaagtgaaaagaattgttaacgaaccaactgctgctgctcttgcttatggaattgaaaaaaaacacgaagagattgttgctgtttacgatcttggtgggggaacatttgacatttcaatattggaacttggagatggtgtttttgaagtaaagtcaaccaatggagatacacatcttggaggtgacaattttgatgatgagataataaagcatttaatttcggaattcaaaaaagaaagcgctattgatttatcaaacgataaaatggctcttcaaagactaaaagaggcagctgaaaaagctaaaatagaactttcaggcgctcaagaagcttcaataaatcttccatttattacagcagatgcaaacggtccaaaacacttacaatatactctaacaagagcaaaattcgaacaaatggtagaccatttagttcaaaaaacaaaagaaccatgccttaaagctattaaagatgctggacttaaagcttctgacattaatgaagtaatacttgtaggcggatcaacaagaattcctgctattcaaaaaattgtaaaagatatattcggacaagatcctaacaaaggagtaaatccagatgaagctgtagcaattggagctgctattcagggtggtattttaaccggagaaactaaagatatggtactccttgacgttactccactctcactaggaatagaaacgctaggtggtgtaatgaccaaacttattgaaagaaacactacaattcctacaaaaaaaagtcaagtattctcaacagccgctgacaatcaaacctctgttgatattaaggttcttcaaggtgaacgtgaaatggcagcacaaaatagaatacttggtaattttatacttgatggaataccagcagcaccaagaggagtgcctcaaattgaagttagctttgacattgacgctaatggaatagttcacgtgtctgcaaaagatatgggaacaggcaaagaacaaaaaattagaattgaatcatcatcaggactttctgaatcagaaatagatcgcatggtaaaagatgcagaagctcatgcagaagaagataaaaaattaaaagaaaatattgaggcaaaaaatacagctaattctttaatttatcaaacagaaaaatcattaaaagaatattctgaaaaaatttcaatcgaagacaaagaaactattgaaaataaaataaaagaattaaaagaaagtcttgaaaaagaagacatttcacttataaaatctaaaacagaagaacttcaaaaagcttcttacaagatagctgagatgatgtataaagattcttcccagcaaaatgcaagcaaccaacaagaaaatggtactcaaaacaatacaagcgaagaaggcaaagaggctgattacgaagttgttgacgaggataaaaaa

SEQ ID NO: 47 - DNA, 561 bp, Borrelia afzelii
atggaaaaaaaagaaactaaaaacgaaactgaaaaaaccaacaagcaagataacaaaaatacaaaatctcaaaaaaaagaaaacttgaatttggtaaattctgataaaaaaattaccgaacttgaaaatgaaatctccaatcttaaagatttgtatttaagaaaacaagcagaatttgaaaacttcagaaaaagattagaaaaagaaaaagataattttgttaaatttgcaaatgaaaccataatgaaagatgttgttaattttcttgataacctagagagggctattaactcttcaaaaaaatctaaagattttgacaacctattaacaggaatcagtatgattgaaaatgaaatactatcaatctttgataaaaaatataatttaaaaaaatttggagaaaatggcgaaaattttgatccaagtcgtcatgaagcaataagcattgaagagaaagaagatcttaaaaatccagaaatagtagaagtataccaaaaaggatattgctacaacgacagaatattaagaacagcaaaagttaaagttgctcaaagtaaaaat

SEQ ID NO: 48 - DNA, 744 bp, Borrelia afzelii
atgaaagatttgaatgaaaataatgacaataataaaggattttttgtagcattaacctcaatcgcaacagtttgcatcataatatttcttgggacaatcattttctttccaaacaaaaatttaacctcagatattgcagagaagaatattgttttagaagaaaccaaagatcaaaacactttagaaaacgttgaccaaaatgaaaaatctttaaaggtatctgaaactccaaatgaaataatcatagatttaacacaagatttaaataaagaaaaaaaaactacacctcaaaaaatacctaatacttctcaaaaatcaaaaattattgaaaaatctcaacctacacctcaaaaaatacctaatacttctcaaaaatcaaaaattattgaaaaatctcaacctacacctcaaaaaatacctaatacctctcaaaaatcaaaaattattgaaaaatctcaacccgtagcccaaaaagatttaaacattgataacatatatgaccctaatacagaatattacatacaatttgtatcactttcagacccaattaatgcagataactatattcaaaaattactcaaatataatatagttgccaaaatatattctgcaacagtagataataaagatatttacagagtgagatctggaccttataaaacaaaatcagaagcaaaagcggactttaaaaaaatagcaggaataagcgaatttaaagaaacttatatattaccggttaacaaa

SEQ ID NO: 49 - DNA, 1503 bp, Borrelia afzelii
atgaataaaataaaaaatcgaatctttatgtattttataatacttttatgtatatcattatttggggcagctaataatacaataaactactctagcattgaaattcctctagaagacttaagtgaagaatttaaagatactgagaataaaaacgatcaaacaaatgccttaaaacacttaaacaaaaatatagcttcttataaagaccttaaaaagggcaaagatctaaaattgccggaaaatataagagacaaaaaactgtttaaaaaaagaatggacgaaaatgatctaaaatctgtaattgaaaattatgaaaataaaattaaaaatatagaaaagcttttaaaaaccaaaaatcaaaaagcatcggcaaatgaaaataaaaaaatagaattaattgaaaaaaaagctaaaaaatatgaaattttaaccaataaattaaaaaacgaaatagtagaaataaaaaagctccttaacaagaaatccagaccaaaagatgctgaaaattatgaaaaaataaatattgaaaacattgatgatgatgatgatgatggtgatgatgatgattttgaagaaaattatgaatataatgacgaaattgaagaaacaaatgaggacaactacccttctaatgaaggaataataaataacctaaaagaaaaactttatgagaacgaaaagtattacgctatcaatgaaaaaaaatttgatgaacttgaagacagaatcaatgataatgaaaatattattttagacttgcaaagagagttaagaaacttcaaaaaaaaagatgactcaaataaaaacttagaagaaattgaagaaaacttgtctttaataggaaaaataatcaatggcctgaaagaaaaaattagcgcaaatgaagcaataaacaaagaaaatcaaaaaaaaataagaactgataaacacaagctcaaagaattagaagataaaatcaaagaaaatgaggaaactattttaaaacttcaaaaagaattaaacaattttaaaaaaaaagaaatttctcaaaaatctttaaatgaagaagctttcattccaagcattccaaacaaaaatgacgacttggaagaaaatgttaaattagaaaagaaatatttaaagcctgcagaaaagaatgaaagccaagatctagaagaaaatgttaaaagcgccccaaaaacaactatgatcaaaacagcggattttcaaatttaccctgacatataccttaataactataattttaaagaaaaaggggaccaatttgcatttaaaaaagaaaacacatactatattgaaatagatccaactaataatttaaatggggctttaaaaaatcatgaaataatttcaaaatataaatttgaaaaatatttcattaaccctactctaaaaaataaagaagaattttttaggaatttaatagaagtcaaaaatatccacgaacttggaattatgtataaaagtttaaaacctgaatttaaacaaataaaaataattaaa

SEQ ID NO: 50 - DNA, 1950 bp, Borrelia afzelii
ttgattctaacttcctattttaaacaaattgctttatttattatttttagattatgttatatcataaaaaaagtaaagattaaattgaaaaggaaaatttacatgaaaaaacaatttgatacagaagtaaatgatttgctttatttaatcattcattctctttactcccataaggaaatatttttaagagaattgatatcaaatgcctctgacgccattgataagctcaagtttttaagcttaacaaatgaaaaattcaaaaacatcgctctagaaccaaaaatagaaataacatttgatgataaaagtatccttatcaaggataatggaatcggaatgaatgaacaggaattaacaaatcatcttggtgtaattgcaaaatcaggaaccaaagaatttattaacaatttaaaacaagatgaaaaaaaatctgcaaatctaattggccagtttggagtcggattttacagtgcattcatagtatcagaaaaagtagaagttacatcaaaaaaagcactagaaagcgatgcttatatttggtctagcgacggtaaaacaggatatgaaatagaaaaagcaaaaaaagaagatccgggcacagaaataaaactttatcttaataaagaaggccttgaatatgctaataaatggaaaattcaagaaattgtcaaaaaatattcaaatcatataaattatcccatttatataaaatacaacgaacctataatgaaggacgggaaacaagaaggaatagaagaaaaagaagaaaaattaaacgaaaccactgctctttggacaaaaaataaaagcgaaattaaaacagaagaatacaacgaattttacaaaaatacaacctttgattatgaaaatccattgatgtatattcatacaaaagctgaaggaaatttagaatatactaatttattttatatcccaagtaaagctccttatgatttatattacccaaacactaaacctggagtaaaactatttataaacagaatctttattacagactctgaaggtagtctgcttccaaactatctaaggttcataaaaggaattatagactgccaagatttaccgctcaatgtaagtagagaaattttacaacaaaataaaattttgtctaaaataaaatcatcttctgtaaaaaaaatactaagcgagcttgaaaagctaagcaaaaaaaatcctgaaaaattttcagagttttctaaagaatttggaagatgcattaaggaaggtgtttattctgactttgaaaacagagaaaaacttatctcattaataaggtttaaatcttcaagtgtagatggattcgtctcttttaaagagtacaaagaaagaatgaatgaaagccaaaaaagcatttattatataacaggcggcaaagaaaatatattaaaagaaaacccaatagtaaccgcttataaagaaaaaggatttgaaatcttaatcatggatgatgaacttgatgaggctattttaaatctaattccagaatacgaaggattaaaactaaaagcaataaacaaaaatgaaactagcaatgaattaaaagatgaaaatttcaaaaaaattgaagaagaatttaaagatacccttacaagggtaaaagaaatccttaaggaccaaataaaagaagttaatctctcagcaacattgataaaagaaccttcagcaataatagttgatagcaatgatccaacttaccaaatgcaaaaaatcatgctttcaatgggacaagaagtaaaagaaattaaaccaatacttgaattaaaccctaataataaaatagtccaaaatttaaaaaatctagagcctgaaaaattagaaaaaataagcattctcctttttgaggaagctctgctaacttcaggaatgcctagcaaaaatccaagaaaattcataaacataataaacgaatttctagaaaaagacttgttg

SEQ ID NO: 51 - DNA, 687 bp, Borrelia afzelii
atgcttgaaataataagtcttggaggaggagtaataaattcaaatcaaatcaacatagaattcattaaaaactttaaaaactttgtttttaaatggttactagaaaatgaaaaaagaaaaatcattttaatagttggtggaggaaaagttgcaagagaataccaagacgcctacaaaaaaataaaccctaattttaaagttagtgagcttgatgagattggaataatgtcaacaaagttgaacgcagaatttctgtgtaaggtaatgaatcctctttgtaaagacaaaattgtcactaatcctttaaaaaacttttcttttaaagggaaaatactaatcgcttcgggctggaaatcgggattttcaacagattacattgccgtaaaatttgcagaaaaatttaataaaaaagatattataaatataacaaatgtaaatcaagtttacgataaagatccaaaaaaattcaaaaacgcaacggcttttaaaaaattaaattgggaacaattacaaaacattgtgggtcaaaagtggaatccaggtttaaatttaccttttgatccaatagcaacaaaactctcttcaaagcttggacttaccctttacatagtaaatggaaataatattgaaaacttagaaaaagttttcaacaaaaataatgattttttgggcactgttatagtaaaa

SEQ ID NO: 52 - DNA, 3483 bp, Borrelia afzelii
ttgttaaaaatcaagttttattttgataaaataattttaggtatgagttttagggctaagtttattcatcttcatgttcattcagattattctcttttggatggagctgcaaaaatatcagatattatatcaaaagcaaaaaaatgcaatatgtcacatattgcattaacagatcatggtaatctttttggagctattaaattctataaagaagctaaaaaagcggggattaagccaataattggcattgaagcttatatggcaaaaacttctaagtttttaaaaaaacatgatgatcttggaaaaatgtcttaccatttaattttgcttgccaagaatgagctgggttataaaaacttattaaagttaacaagtatttcttatcttgaagggttttattatcgtccaaggatagataaagaggatcttgaaaaatattcagaaggtttaatttgtacttcagcttgcattgggggactcatcccaagacttattttggccaatagatttgaagatgctaagaacgaaattctttggtttaaaaaagtttttggcaatgatttttatcttgagcttcaaaggcatggcattaaagatcaagacattgtaaatgaacggttagttgaatattctaaggagcttggagttcctttaacagtagctaatgattctcattatgttaatagagaagatgcatctgctcaagatatcattgtttgtattgggactggtgctaaaaaaagcgatgagaatagactgaaaatggagacaaatgaattttatattaaatctcaagaggagatgtgtgaactttttaatgatttgcccgaagctttagaaaatactgtaaggattgcagaaaagtgtgatgattttaaaataacttttccaggccctattttacctgattatcaaattcccattgaatttaatactcttggtgaatatttagaatatctcactcttgaggggttaaaatttagatataaaactttgacaagcaaaataaaagatagagccttttatgaattgagcgtgataattaggatgggttttgaaggctattttttgattgtttgggattttattaaatttgctcatgatcatgatattcctgttggagctgggcgtggctctggtgcgggttcaattgtagcctatgctcttaggattaccgatattgatcctttaaagtataatttgctttttgagagatttttaaatcccgagcgcatttctatgccagattttgatattgatttttgttttgaaggcagagatgagattataaaatatgttaccaataaatatggagaagataaggtagctcaaataattacttttggaaccttaaaggctaaggctgtggttaaagacgtagctagagttttagacattccatttgctgaatcgaatgaacttactaagtttattcctgatggtcctaaagtttctttaaaagaggttttagacgacaattctttaaaagagtattttactagcaaacctgtttataaagaattaatgaatgctgcattagttcttgaaggaatgaatagacatgcttcaactcatgctgcaggaattgtaatttctaaaacccctttaaccgattatgtacctctttataaggattataagcaaggttctatttctactcaatatacaatggatttacttgaagaatgtgggcttgttaagatggattttcttggcttgaaaacattaactttaataaaaaatgcagaaaatcttattagaagtgtaaatccagattttaaaataaaaaatattccagataatgatgttaagacttttaagatgttaggagaagggagaagcgcatctgtttttcagtttgaatctgagggaatgcagcaaattctaaaagacgcaaagcccgataatattgaagatttgatagccttaaatgctctttataggccaggccctatgcaatttattcctcaatttattgctgctaaaaaaggtgttaagaggattaagtatccccatccagatttaaaggaagttttaaggccaacttatggagttattgtttatcaagaacaagtaatggaagttgcaaaaataattgggggtttttctcttggtaaggctgatattttaagacgtgctatgggtaaaaagaaagaagatgagatgaatgaaatgaaggttgactttttaagaggcgctattgagaaagggtatgacaaagaaattgctagtgaaatttttgaacttttaaagcctttttctgggtatggatttaataaatcacatgcggcagcgtattctttaatagcgtatcaaactgcttatcttaaggctaattaccctgagtattttatggctgctaacttgacaaatgaaattaataataacgataagctgtcttattacattgaagaatcaaaagctatgggtataaacgtgcttaagcctgatataaatcgatcatttagagaatttcgtgtaactgactctggaatttcttatgggcttaatgggattaaaaatcttggaggaattgttgttgatttaataattgatgagagagagaaaaacggcaaatatagttcttttgaggattttatcagacgtgtagatgataaagtaattaataagaaatttttagaatctgcaataaaatctggactttttgatagtttaaatcaaaatagaaaaactttatttgaaaatcttgatcgtttgattgaagttgtttcagaagataaaaataataaaaggcttggtcaaaatagtttgtttgatgttcttgaaagtcaagagtcaattcagcaaagttttaattatcaggttttgaaagaatattcttattctgagcttttaggatttgaaaaagagcttttaggattttatgtatcagggcatcctcttgatccttataagaaggcgattaataatttttccagtttaaatgttttaaaagatcttgctgctaaaaaagatagcattgttcaattttctggcattttaaattcagtaaaaattattcaaactaaaagaaataattcaagaatggcttttggtgttattgaagattttaaaggcgcaatagatattgtagtttttacagaaagctatgaaagatataagaattttttacttgaaggtaatgttattggggttataggtagacttacgtttaatagagacaaattttcaattgtagttgaaaaagttgtaaatattgagagactctcagaagataaagtaaataatattcatattaaatttttaagtaataaattaaatgatttgcaattacttaattctttaaaggaaagtataagtaattttgaggacaattctggattttcaaatgtttatttttatttaagggaaaatggtaaggatttaaaattaaaaatgaattcaattttaaattttgggccagatgaagacaagcttgataagttaagaaggtgtgtgatagttgaagatgtttgggttgat

SEQ ID NO: 53 - DNA, 792 bp, Borrelia afzelii
gtgaacaattttttaattaaacttttgctttttttgttagttttttcaaacagttatgttgctttttctaaaaacagcaatgttttaataataactgctatggactctgaggttgagcagataaataagcttatgtctaataaagaagaaatagtgcttaaggagtatggtcttaataaaaagattttaaagggcaagttgtctaatcgcaatgttattactattgtttgtggggttggaaaggttaatgcgggtgtgtggaccagctatattttgtcaaaatacaacataagtcatgtaattaattttggagttgctggtggtgttgttagtgataaatacaaagatattaaagtgggagatgtggtagtgtcttcagaggttgcatatcatgatgttgatttgactaaatttggacacaaagtaggacagcttatgggattgccgcaaaaatttagtgccaataagaatttggttgataaagctacaaaggctgttaaatctaaggctgtaagctctaattcatattcgggattaatactgtcaggagatcagtttattgatccagcttatattaacaaaattataggaaactttaaagatgtaatagctgttgagatggaaggtgcagcagtagggcatgtttctcatatgtttaatgtaccttttatagttattaggtccatatctgatattgtaaataaagaaggaaatgaacttgaatatagtaaatttcttaaattagctgcttttaattcagctaaagttgtacaagaaattttaaggattctt

SEQ ID NO: 54 - DNA, 1857 bp, Borrelia afzelii
atgaaaaatcatattttatataaattaattatatttttaaccacatctgcagcaatatttgcagcagacgcattaaaggaaaaagatatatttaaaataaacccgtggatacctacatttggatttgaaaacacaagtgaattcagatttgatatggatgaacttgtccctgggtttgaaaacaaaagtaaaattactattaaacttaaaccatttgaagctaatccagaattaggcaaagacgatccattttcagcttacattaaagtggaagatcttgcattaaaagcagaaggcaaaaaagacgctcaattcaaaatcgatgtaggagatataacagcccaaattaatatatacgatttttttattaaaataagtactatgacagattttgactttaataaagaatctttatttagctttgcgcctatgactggattcaaaagcacttactatggattcccaagtaatgatagagcagtaagagggacaattcttgcaagaggtacttctaaaaacataggaacaattcaactgggatacaaactcccacaaatcgaccttacatttgcaataggaggaacaggcacaggtaacagaaatcaagagaatgacaaagacactccatacaataaaacctatcaaggaatcctttatggaattcaagcaacatggaagccaataaaaaatatacttgatcaaaacgaagatactcaatctgtaattgcagaaacaccttttgaattaaactttggcttatcaggagcttatggaaatgaaacattcaataattcatcaataacatactctttaaaagataaatccctaattggtaacgatttattaagcccaactttatcaaattctgcaattttggcatcttttggagctcaatataagcttggattaacaaaaatcaataataaaaatacctatcttattttacaaatgggtactgattttggaatagatccttttgcaagcgatttttctgtatttggacacatctcaaaagcagcaaatttgaaaaaaggaatatctttagatcctagtaaaaaagccgaggatatatttgatccaaatggcaatgcccttaatttcaataaaaatacagaactaggcattgcattttcaacaggagcaagcatagggcttgcttggaataaaaacgccggtgaaaaagaatcttggaaagttaaaggatctgattcctacagtacaagactatttggagaacaaggcaaaaaatctggagttgcattaggaataagctatgggcaaaatctttacagatctaaagatacagaaaaaagattaaaaaccatatctgaaaatgcatttcaaagcttaaatgttgaaatttcaagctatgaagacaataaaaaggggcttatgaatggactgggttggataacatctatcggtctttatgatattttaagacaaaaatctgtagaaaactatcctacatcaaccttaagtgctaatgagaacaatcaagctggacaaagttcaacaggcacacaagccataacacctaatctaacatttgaagacgcaatgaaactaggcatagctttatatcttgattatgcaattccaatagaatccatttcaacagaagcatatgtagtaccatatattggagcataccttttaggaccttctaataaaatatcaagcgatgctacaaaaatttatttaaaaacaggacttagtcttgaaaaactaataagatttacaacaatttctcttggatgggattcaaataatattatagaacttgctaataaaaacgcaaataatgctgctattggcagtgctttcttgcaattcaaaatagcctacagcggaagc

SEQ ID NO: 55 - DNA, 1428 bp, Borrelia afzelii
atgagtattgtaattgattcttttagagaaatatcaaaaattccaagatgttcaaaaaatgtcaaaggaattattaattttattaaggagagagccaaaaaatttggttattcttttaaagaagatagtgttggtaatattgtggtgcagataaaatctaataataacattgatatgcctcctattattttacaatctcatgttgatatggtttgtgaaaaaaatgaatcaagtttacataattttgaaacagatccaattaaaattgttgaagaagatggatatcttaaaggagtagggactactcttggagctgataatgggattggggtagctatgatgttgggcattatgagtgaggctgatagtttcccccatcccgatttagaacttctttttaccgttgatgaagaaataggtttaataggtgctcttggtcttgattctaaattatgtaatggtaaaagccttattaatcttgatggagaggaagaaggatattttttagttggttgtgcgggatcaagacttgttgagattgttttttctcctcaatataatcttgcaacaaaaaaaacaaaagtggaaattttgctcaaagggcttaaaggtggtcattctggggcagatattcatttagatttggcaaattctttaaaattaatgttttttgctctttttgaaattaaagcaaatattgattttgagattgaaagtatttttggtggagagagcagtaatgcaattccaaatgaagccaaggctttaatctgtatcaatgatagtgattatgaattattaagtaaagagcttaaactttttgtatttaaagttaaaagtatatattctcttgaaaatgaatttgacattattgttaataaaaaagaattttcatcagttaaagttcttgatgaaaatagcaaaagcaggcttttgaatatgggaatgggatttttacatggagttcaaagagtagaaaattatgaaaataagcttatcaagacctctttaaatttttcaagtcttttcaaaatgcaagatgagtatatttttacttttttaataagatctttattggattcagacaaagagtatgtgtttaatcatttgcaatcaataagtgatttatcaggagctagttggcgtataatttatgattatccttcttggaaatccgataagaatagtagtcttttaaaacatcttcaaggcgtttataaagagatgtatcttgaagatgctaatgtttctttaatacatgcagggcttgaaacaggtataatatcttctaagttaggaggcatagagtctgttactcttggaccttggattgagtcgccccatactactagagaaagggtaaatatttcttcggctattagagtttatgattttttgaaaaaaagtttagaaagatttcaaaaattt

SEQ ID NO: 56 - DNA, 1290 bp, Borrelia afzelii
atggcaagagtaaaaggtcaaaaagtaaaagaatgttctttttgtggacttagcgttgctgagcttgggggcaatgttgttatatctaatggggtagcgatttgtccggaatgttccaagatatgtcacaatctttttaaagaaaagttgtgcaagtcgctggattctagatccaatggtttgccaacccccaaacaacttaaagatcatttagatatgcatgttgttgggcaagaagatgcaaaaaaagttttatctgtggctgtttataaccattataagagaatattgaaaaataataaatatgatgatggtattgagattgaaaaatccaatatacttttggttgggcctacaggtagtggtaaaactttgcttgcaaaaacgttggctgcagagatgaatgtgccatttgcaatagcagatgccacaactttgacagaagctggatatgttggtgaggatgtagaaaatattttacttaaattgatacatgctgctcatggggatgttagtctagctgagaaagggattatttatatagatgaaatagataaaattgctaaaaaaaatgaaaacgtttcaataacaagagatgtgtctggagaaggggttcaacaagctttgttaaagataatcgagggtactattgctaatgttcccccaagaggtggtaggaaacatccttatgaggatactattgaaattaatactcaaaatatactctttatatgtggtggtgcttttgttgggcttgaaaatattgttaagaatcgaataaataaaagttctattgggttttcagcaattgaaaaaaagaatataagagatgacgcttcattaaagtatttggaaatggaagatttgattaaatttggtttaataccagagtttgttggtagacttcctgtacattcgtatcttgaaaagctaagtaaagaagatttgattaaaatattagttgatcctcaaaattctattgttaagcagtattatcatatgtttaaaatggacaatgttgaattagtctttgaaaaagatgctttagaatcaattgtagatgaggctattttaaaaaatactggagcaagaggccttagatctattttagagggtcttcttaaagatgttatgtttgaggttccttcgattagtaagactaagaaggttattgttacaaaagaatctgttttgaatgcagatattaacccattaattttggtggggaatgcaattaaaaaaccttgggcaaaagagttatatgaaatcaatcttaaatatgataaaaaa

SEQ ID NO: 57 - DNA, 2439 bp, Borrelia afzelii
atgcaattaaaaaaccttgggcaaaagagttatatgaaatcaatcttaaatatgataaaaaatagaaaagaagatcttccaattgttattttaaaagaaaatgttcttttcccaaatgtgacattgtgggtaacctttgataatgaatatgtaattaactccatagctcaatccatgctagaggaaagattaattctgtttgcttatccaaatgaatctaattatgacgaatctggtaaagaaggggttaaaaacctatgttctgtgggcacttattctaaacttatccaggttataaaggttagtaaagacgtagtaaaagttttggttgaatgtcaaagtagggttctaataggcagtgtttcaaaaaaaaatgattatttaagagccaaagttacttttgtgtctgatgctgagggattaaatagggaactttttacttacgctaaatttttaaaagaaacttatgaagtttatagaaattccctatctttaaaatcttatgatagcgataatgagccaattaattattttgagaatccaagcaagcttgtcgatattatggcctctaattcaaacttagaaaatagtgtaaaattagatcttttacaagagttaaatgttaaaactagaatagaaaaattaattgttaatttaaacattgagattgaccttttagaccttaaaaaagatattaattctaaagttagagctaagctggataaggggcaaagggattattttctttctgagcaagttaaagagatacaaaaaagattaggtaaagatgaaaacgagtatattgatagattaaattctaaagatattccagaagatgttaaatctaaggttgaaaaagaaatttctagattatctaaaatgcagatgaattcccctgatgctaatattattagaagttatatagaattaatattagatcttccgtggaatgaaaatactgtcatgaaaaatcatttaagcgagattgaatttatcttaagaaattctcattatggcatggatgaagcaaaagaaaagataataaattttttagctgtttatcaaattaattctaaggttaaagctcccattttatgccttgtagggcctcctggtattggcaaaacatctcttgtagaatctattgcaagatcattgtctagagaatttgttaaaatatctcttggtggcttaagagatgaggcagagattagagggcacagaagaacttatgttggctctcttccaggtgtttttattagtgcaatgaaaagatccggcaagtctaatcctgttattcttcttgatgaaatagataaaattaataatagttataaaggaaatcccgaatctgcccttttagaagttttagaccccgagcagaattataaatttatagatcattatttagaaattccttatgatctttctaatgttttatttgttacaacagccaattctcttaatggtatgtcaaagccacttcttgatagaatggaaataattaaagttgagggttattcttatattgaaaagttagagattgcaaagatttttttgattccaagcataattaaagagagttttttagacaaagtttatataagaatagaagacgatgttatttttaatttaattagaaattatactatggaatctggcgtaaggggactaaagagagtattgactaatttgattaggaaacttgtaagggagttgctttataagtattctaaagatcaaattatcaaaggcaatttttattcaccaagttctttaatacatggaaataattcgctttttactcatgatcctgatattccaggtatttataaaataatcaatattaataattattataattatgttgatactgagtataacttggatttaattaagattgactcttctggatttgtttatggacttgcttggacaaattatggtggcacagttcttcctgttgaggcaactaagtttgagaaaaaaggagacattattttaacaggtagtcttggaactattatgaaagagagtgcacagcttgcatattctatagttaagacctattcttctaggcttaattttgacgtaaaagaaagtcccgaaattcatttacactttccagaaggagcaacaccaaaagatggaccttctgcaggtattaccattgcaacagcaattgcttcaatactgtctgataagaaagttcctttggatcttgcaatgactggtgaggtgactttaaaaggttttgttcttcctgtgggcggcattaaagaaaaagttttagcagcctatagaaacggcataaataaagttattttgcccaaagataataaaaaagattattttaagcttccagaagaagttaaagataatatagatgttaagtttgtttccagtttggaagaagtttttgattatttgaatattatt

SEQ ID NO: 58 - DNA, 2094 bp, Borrelia afzelii
atgactacattgttcaaaatactggcattaaggaaaagtaaaacgttttatgttttgcaaattataaaacttattatattattttattttttaataataagtcctgctaatcttaatgctgattttgagtataaggttggcaaaggagatactcttttttcaattgcaattaagtataaagctaaagtaaacgatcttaaaaggattaataaacttaatgctgacaatattagagtagggcaaatattaattattccaagtgattctagtttagatccaaatattactcataaggtcaatcattctcttaattcgctagaatctattaagaagggggtaattctttacactgtaaaagagggtgacactattgagagtgtttcaaagcttgttgggctaagtcaagaagagataatagcttggaataatttgcgatctaaagatcttaaagttggaatggagcttgtgttaactgagcctgattttttaaagccctatgtagttaagaaaggcgattcactttcaaaactttctcaagattttgatattagttctaaggatattttaaaatttaattttcttaatgatgataaattaaagattggtcaacagctttttttaaagagagctactaagaatattgattttcattatgttaaaaaaggagaaacccttggtagaatagcttatatttatggtgttactgctaaggatcttgtaactcttaatggtaatcgtgctgttaatcttaaagcaggttcattgctaaatgttttaaagattgtaaatgatgatttagaaaagtctgttgaggaagatttaaaaattgaaaaaaaaacagataatcagtttatctatcattcagttgctgtaggggagactttgtatagtattgctagacattacggcgttttaattgaggatcttaaaaattggaataatttaagtagcaataatattatgtacgatcaaaaattgaaaatttttgataaaaaacttttatttgattcttctatagctaaatctaaaaacgatttatatattaaaaataaagttgattctagctctaattcttctaatgaagttaaaacaatagttaatcttccctcaagtaaaaacaaaaagctaaatttaaatacttttagaattactaccaatcaagatttttttgatattagctctttggttattttagactccaaaataccaatatttgaggttgttggtgatttctattattggtatagaccaaaaaagataagtcagccaagtgagttttattcagaagattggcattctcctttaaattcctataaaaaggcaactcaacttttcaaaagttttgaaaagttggtaaattctaggtttaataaaggatcaagacttaaagataagttaataattcttgatcctggtcacggaggccttgatcctggagctattgttaaatctagagatggtcttggaaacgaagtttttgttgttgaagatgaatatgtgtatgatattgctttaaggctttatgtataccttaaagaagagggtgctaatgtcgaacttactattttggctcccgatcatttgattaggaatagtgtttttgctaacaatacttttgttaatgttaaaaatgaggtttacaatgattatgatctaaataaaaatgatactgttgattcctggataaacggtactccatcaggccttaaaaaaagattggttgttgttaaaaacattgttaataaatataaacatattaaagataaggatatagccttttttagtttgcatgcagataatagtgttggagcacctaagagtatggggttttattatcaaaaagatgacgaaaaaaaatatgatattcattcaaagtctgtagcagaaaaaattacagaaggaatgaaaagaagtttttatattaagggtcaaaatctccatgttttaagaaacaatgtagtaatgactaagcttttaatagaagttagaaatttagcatttccagaagaagcttggtctattagatcttctaagcttagagatcaagattccaaaattcttgctaatgggattttaaaaatattagaaaataat

SEQ ID NO: 59 - DNA, 1686 bp, Borrelia afzelii
atgtttagaaaactaaaaaaatcaaaaacttatattattattatttcaataactaaattttcagagaataatctgttatcgataatatcaaatataaaatatttgattgagcacaaacagttagcttacaaaatacattggacattcccaatatatttttttgaaattctaagagaacatgaggaattaaataaatggctatttgaaagattcaaaactaatacagatatatatatgcctggaacttacagtggaagccctcatgaatacatgctacacgatgaaatacatttagatttatattgggcactaaaaaatccattcaaaagtggatacaaagatatatttcaaaatactcctattatgctttacatatacaacatagaaaagtttaggaaaaaagtgactgagctttacagaaagcttaatttcaactatacagaaggaataaggcagagcaaaaataataaaacgtacttaattttttataaaaataactgccaatatttatatgaagtccaaaaaatagattctccaagaagcaatgtagaaactcttatttatttttatgaaatcaaagaaacttatgataatcaagaattaaaaaattttttactttatttaaaatctttggaaaacagcttgcatagtatcaagatacaaaatctagcaggatccaaactaactaccgaactgctagaaattccaaaatttaactctcttaaagagcaagagccaataataaattttcaaaacaaaagactcaaagattatcaaatcaacgaaaaaagtttaagagaatttttaataaacaaacaccaagaagaaattgtcagaaattcagaatcaattattcctaagaatctggaatataatatggaaggaaatttcacattatctcacgatcaatacaatattaaatttgaaaatgggaaattaaataaaataaaatttaaagataaaaaagttgaatttctaaatacatctagaacctatttcaaaattttatcaaaaaaagaattaataaaagaagcatctattgaaagctcattttccttctcaaatgaaaaaattttaggaataaagcaatatttagcttttaactccactacaaaatcaacaattgattttttcatagacgagactatctctagcttttttgtatctattaaaataaaatggccttctaaaatcaatctggataaaaaagcattaaaaaaatacaatcctgattatcttcttgaatattcagcacttgaaatacctgtttttgaaattacaaaaggcactaatttaaaaataacagcaaaatatagtgatcttgatacttatgaaaaaataataataactaaaaacaatcccaaaggctacattaacggtacagaatttttaatatctaagggaaatgataaaaatagtaatttttttataagctttttaaatgttgaaaaacaaatcattcatacaattaattataaaattgaaaaaataaattctaaaaaatggttaatcctaaacataggtggctcttataacaaagttaagatccaagatgtaataaattactctcagacactaaatttaatgatactacccttaaataataattttgataacaaaataagactgaattcaaaaataaaaaatttaattttttatactaatataaaaaaatatgaaaataaa

SEQ ID NO: 60 - DNA, 1635 bp, Borrelia afzelii
atggctaaagacatatattttaatgaggatgctagaaaaagcttacttagtggcgttgaaaaattatccaatgctgtaaaagtaactcttgggccaaaagggagaaatgttcttattgataaaaaattcggttctccaacagttacaaaagatggggttagcgttgctcgtgagattgagcttgaaaatccgtttgaaaatatgggagcgcagcttttaaaggaagttgctattaaaacaaatgatgttgctggtgatggaacaacaactgccactgttcttgcttatgctattgcaagagaaggccttaagaatgtttcctcaggaattaatcctattggaataaaaaagggaatagatcatgctgtaagtttggctgctgaaaaaattcgtcagtctgcaaagaagattacaacaaaggaagagattgcacaagtggcttcaatttctgctaataatgacagttatataggtgaaaaaattgctgaggcaatggataaagttggaaaagatggggttataacagttgaagagtcaaaaacttttgatactacgatttcttatgttgagggtatgcaatttgatagagggtacctttctccttatttttccaccaataaagagaatatgagcgttagttttgacgatgctttcatattaatatatgagaagaaaattagctccattaaagagcttttaccagttcttgagaaagttttgggaacaaataaacctttattaattattgctgaggacattgaaggggatgcccttgcagctcttgttttaaacagcgttagaggagctttaaaggtttgtgcaattaaatcgcctggttttggtgatagacgaaaagcaatgcttgaggatattgcagtgcttactggcggtgttttaatcagtgaggaactaggccttacacttgagacagttgagattgagcaacttggacaggctaaaactattaaggttgataaagataatactactattattaatactggcaataaagaacaaataaaggagcgttcagagcttattaaaaaacaaattgaagattcaacatctgaatatgataaagaaaagcttcaagagcgtcttgcaaagcttgttggcggagttgctgttattaatgttggagctgttactgaagtagagcttaaggagaaaaaacatagagttgaagatgctctttctgcaactcgtgctgctgttgaagaaggtgttgtgcctggtggtggatcaactcttattgaagttgctatgtatttagatacaatagatacaagcaaattaagctatgaggaaaagcaaggttttgagattgtaaaaagaagtcttgaagagccaatgagacagattatttcaaatgccggttttgaaggatctatttatattcatcaaattaaaactgagaaaaaagggcttgggtttgatgcttccagctttaagtgggtaaatatgattgagagtggaataattgatcctgctaaggttacaagaagtgcgcttcaaaatgctgcttcaattgctggacttttattaacaacagaatgtgcaatcaccgatattaaagaagagaaaaatacttctggtggtggcggttatcctatggacccaggaatgggaatgatg

SEQ ID NO: 61 - DNA, 759 bp, Borrelia afzelii
atgctaggagattttatgtataaattagttttagtaagacatggggagagtgagtggaacaaagaaaatctttttactggttggacagatgttaaactttctgataaaggtgtcgatgaggctatagaggcaggtttacttctcaagcaagaaggctatttttttgatattgcttttagttctttattgtcaagggccaatgatactttaaatattattttaaaagaactaggccaagcttatattagtgtaaaaaaaacttggagattaaatgagagacactatggagctttgcagggtttaaataagtcggaaacagctgcaaaatatggggaagataaggttttaatttggagacgcagttatgatgtgcccccaatgtctttagatgagtctgatgatcgtcatccaattaaggatccaagatataaatatattcctaaaagagaacttccttcaacagagtgtcttaaagatactattgcaagagttattccttattggattgatgagattgcaaaagaaattcttgaaggtaaaaaagttattgttgctgctcatggtaattctttaagagctcttgttaaatatcttgataatttaagcgaagaagatgttttaaagcttaacattcctacgggtattcctttagtttacgaattagataaagatttaaatcctattaaacattactatttaggtgatgaaaacaagattaaaaaggcaatggaatctgttgctagtcagggaaagttaagg

SEQ ID NO: 62 - DNA, 1080 bp, Borrelia afzelii
atggcaattaaaaaacgaaaattttataaaagatttatatataaggagttggtttacatgaagaggaaagcgaaaagtattttattttttttattatccactgctctttttgctcaagagactgatggattaacagagggctctaaaagggcagagcctggagaattggttttagattttgctgaacttgcaagagatccaagttcaactaaacttgatcttacaaattatgttgattatgtttattcaggtgcttctgggattgttaagccggaagatatggttgtagatcttggaataagtaattggagtgttttacttactccttctgcaaggttgcaagcttatgttaaaaattcagttgttgcgcctgctcttgttaagagcgaatccaaaaggtatgcaggtgatactattttaggagtaagagttttatttccaagctattctcaatcatctgctatgattatgccaccatttaaaattcctttttattcaggggaaagtggaaatcaatttttaggcaaaggtcttattgataacattaaaaccatgaaagagatcaaagtatcagtttatagtttagggtatgaggtagatcttgaagttttatttgaagatatgaatggtatggagtatgcttattctttagggactttaaagtttaaggggtgggctgatttgatttggtcaaatcctaactatattcctaatatatcagctagaataattaaagacgatgttcccaattatcctcttgcttcaagtaaaatgagatttaaggcttttagagtttcaaaatctcatagttcaaaagagcaaaattttatcttttatgtgaaagatttgagagttctttatgataagctaagcgtttcaatagattctgacattgatagtgagtctgtatttaaagtttatgaaactagtggagctgaatcccttcgcaaattaaaggcacacgagactttcaaaagagttttaaagcttcgagaaaaaatttctatgcccgaaggttctttccaaaactttatagaaaaggttgagagtgataaacctgaagaatcatcttcagaaaat

SEQ ID NO: 63 - DNA, 1398 bp, Borrelia afzelii
gtgcagataaaagaaatttattttggacccaaaattttagatgataaaaatagtaattctaaattgaccaattttgattttaaggttgtttcttttgagcttggatcggatcattatttagtagacattatgcaggttaaagaaattagaaaatctagtaattttacttatgttccgaatgccaaaaaatatgtagctgggcttgataatttacgaggcgaaataattcctattatagatcttagaataatgtttaatttggaatttaataaaaaagatcttgaagatattatggttttaaaacataaagaccttcttataggggtgattgttgataaaattaataatgttttttcaatagattctagtcttattcaagatccacatccagttttatctcaagattctttaataaactatataaaaggcgttgtagattataacgaaaaactttatatacttcttgatgtttttaaaatttttaattatggcgaagaagaaagggttttaacctccggtcaaaattttgttgaaaaaaccgattttgtagacgattgtggtaatttagatatcctggagaatgctaaaagtaatttatctaataatggtttttcaaaaaatactaataataatgaaaattcaactgtaaacaatattgcagcttttaatttggagaatattaaaaaaaatcttttgaaattctcgtttaatgcttctttagtaaatgatgtgtttttagaaaaagttggagtaaaatttaatatggttgatactgattgcttgccttacgatagttttttaaatgaattttattcaaaatcatcaggaaatctatggggagctgattgtttggaagaatttcaaaatgaaattgttaagaatcgcttaaattttatggataatttgaattctattttcaatatattagaaattggttgcggtaatggaagggagactatggccctagttaacgctttgtctgagtattatgtaggaccgtttaagttgacagctattgataatgatttatcaaaagtggttgaaacttccaggttgattttttcagagtcagaaattggtattagtgaaatttatcgtaggaactcttttgaacaaagtcctggagtttataaatttaagtcagaaattcttaataacgttttatttgaatattctgatgctcttttttcagatttgcctgatcatttgggaatggtttttttaaaagatgttttatgtttcttggatagtaaagatcaaattttaattttgaatattattgcttccaaaactattaaaggggctcttttgtttttaggagataatgaagaacttaaaaataatgatatttttataaaagaaaaatctacaaaatattttaacttgtacaggagagtc

SEQ ID NO: 64 - DNA, 2259 bp, Borrelia afzelii
atgctattgaagcttaaatacagttttgttggatttttattattgtttttaatttttatattattgcttttttctatgatttttaattttgttttatgtggttatttagaagattattataagcaacttacaagggcgcaattaagaagagcagctttttctacacaatcttttttggacactttgtatgttatagtcagtggtgcagcttctaatttggcacttgaaaccatatcagaatttgcaatttatgagaatagaggaaaagatttctctgagtctgaattgatagatttaagaaaaaatccaaaatttgttattgattctgtaaaggtgaataaaaaatatcgacaatacttatacaattttatggccaatcttaaaaatgataccttttttgaagaatttgcattttttgattttgaaggaagaataattgttagcacaaggcatgaaaataatatggattttggtcattctgaggctaataccaattattttaaaaaagcggttgaggattataagcaagaccaattaaaatttataggttggtattcaaatctttctgaaggaatatctgcagaggttgccattaggtctaggcaaagcgaaaaaaaggcttttgcaataattgttcctgtatattctccagaagataaacttgtttgtgggtatttggctggatatttgcttaatgatgttttggcagatagttttgatagatttagattcggtttttataaaagaggcaattttatttatgtggatcctaataatatagcagttaatccttttgaagaatacaatgaaattagtagggttagttctaaatttttaaatactcttaaagatgttttttctaagccacctcttttatcaaatattcctaccgaagtttcggtttatactattgatagaatatttttccccgaaatgggagaggaatgttattatgcactgttgcctataagtagcaaattaggagaaaaaggtggagtacttattgctagacttccttataaagatatttacggagtaatatctagcataagattccagtatgtcttatattctgccttaggcattattttattaagcattgttcttttggcaagaatagatagggttattagttttcgtttaaacgcaattagagttttagttcaagatatggttaatggaagtttagataaagattatgctcttgatgatggcgatgatttttctgatgagcttagtatgctaagtcttcgggttgtgaaaatgaaaaaagctatttctgtagcaattgcgagtgttttgagaaatattagctatgtaaataaggcaagtttggaggttgccagttcgagtcaaaatttaagctctagtgcgttacagcaggcatctgctcttgaagaaatgtcagctaatgttgagcaaatagcgtcaggtgttaatatgagcgcgaataattcttatgaaacggagcaaatagctttaaagacaaatgaaaattcccatataggcggtaaggctgttgaagaatctgttattgctatgcaagatattgtagagaaagttagcgttattgaagaaatagccagaaagaccaatttacttgctttaaatgcggctattgaagctgcaagagcgggtgatgaaggaaagggatttgctgttgtggctagtgagattagaaagttggctgatcttagtaaaatttcggctcttgagattggagaattagttgaagataactctaaagtagcaactgaagcaggagtgatctttaaagaaatgttacctgaaatagaagaaacagctaatcttgttaagaagatttcagaaggtagttctaagcagagcgatcagattgctcaatttaaaatggctttagatcaagttggagaagtagtacagtcttcagcttcaagtagtgagcaactttctagtatgtccgataaaatgctagaaaagtctaaggaactcagaaaatctgtattattttttaaaattaaagattctaagattgaaaatctggaggatggtgagtatgatttcagattaatggattgtcctgaagattcttttaaagatgaaaatcaagatttaaaaagtaatggaatttcgactttaaatggtagtaggcataataatcattctttaagtattgagtctgagccttctgtaagagctattaataagcgagttgatcctaaaaaagctatcgatattgctgataaggatttaaattttgatgatgatttttcagagttt

SEQ ID NO: 65 - DNA, 951 bp, Borrelia afzelii
atggatttgattagtttttctgtgcctggaaatttgcttttaatgggggagtatactattttagaggaaagaggattggggttggcaattgccatcaacaaaagagcatttttttcttttaaaaagagcgattcttggcgtttctttagtaaaaagaaagagatagacgatttttctttaatagaaaatagaaatgattttgtttttaaaatgtttgcttacttaaatcaaaattgttttttcaacctagaaagctttgcatatgatgtgtatattgatacaagtaatttcttctttaatgatggaactaaaaagggatttggctcaagcgctgttgttgctattggcatagtttgtggactttttttcatttataatgctactaatgttgttgagaaaggtgaaatttttaaatattgtttggaagcttacagacattctcaaggaggaataggtagtgggtatgatattgctactagtatttttggaggtgttgttgagtttgaaggtggttttgctcccaaatgtagacaactaaatgctgtagagtttaatgatttttatttgatgcagggtttgcaagcggttaaaaccaccgattctatttatgagtacaataagcatagagattctattttagattttatattaaaatgcaattcagagatgaataaacttgttttaaatgtttgtagttctaaatctgccttgatttctagcttaagaaaagctaaagaattaggcttggcaattggggcggcaataggagttcctgcagctttgcccccaagttttgcgcaccttcagtatcaatgtgatttgattaaagctttgggggctggaaatgaaacttttttagtttacaagcccaatatcgaagcttttgatttaccaaaaattattccaattgttttagagcacgaaagtattaagtttgaaagcggtaaatgt

SEQ ID NO: 66 - DNA, 1569 bp, Borrelia afzelii
atggagtatttgcaaactacatcttcaattaaagctaaatttgatattgtagctattgtggagcaatatattaagcttgttaaatcggggtctacttataaagggctttgcccttttcatgctgagaaaaccccctctttttttgtaaatcctttgcaaggatatttttattgttttggatgtaaaaagagtggagatgttattggatttttaatggatatggaaaaaatcaattacaatgatgctcttaagattttgtgtgaaaaattcggtgtttattatgatgatttaaaaataagtagagaaagtgtaaaaaaaaatgaaaataaagacatagtttcaaaaatttactctttgaattctagattaattaatactattaaattttttttgaataaaaataaaaaagctttagattacgttttaaagagtagagcaatatctaaggaagttgttgatttatttgaacttggttatttaccgcttaatgttaaagatggtttagagcttcatggctttttagtttcaaaaggatattcttctgaaatattgaaaaaaagtggtttattttcaaaaataaaccccaaagcttctattttatctcaaaggttaatttttccaattaaagattttaaaggaaacgttgttggttttgggggtcgagatttagatggaaaaggttctaagtatattaatttaagtgaaactgaagtttttaaaaaaaaggagcttctttatggattttatgaggggcttgatgagattaaatctacaaagtcagtcatattagtagaaggatatatagatgttcttgctttttttacatctgggattaaaagagcagtatctactcttggtacttctttttcaaaagaacatctggttttgattcaaagatatgctgatgagataatattttcttttgatggcgatgatgctggactttctgcaactttaaaagcttatcaaatttgtttgccatttaatattaatgttagtgttgttaaaatggattttggtcgtgatcctgcagatgttcttaaaagtgaaggtgaaagctctttgcaggaaattttaaataatagatgcgatgtttttgactatcttttagatgtttattctaataaatatgatttaaataaaactgtagatttaaatgcaatgattaatttatttttaaacttgataaatttatcaaaagtagatacccagaaaaatatttttttagacaagttaagtaataaacttggtattggtgtgacaacgttattaaaagattattataggataaaagaaagatttgcagttgacaataataaaagaaatttgtatgctcataatgatgattcttatgagaggtatctaatagtagctttgttgaaaaattttagttattttagtataataaggcgcaatattattgatagtgatttaattgacgtcgatgccagaaaaatatttatgtgctttgaaaatttatttgaaaataatgaagatttttcattaatggatttaaaaagaaattcaaaggataactataaaattagtgagttttttttgaagaaatct

SEQ ID NO: 67 - DNA, 675 bp, Borrelia afzelii
atggaaaaattagtttttaaagagaacaccatatattcaagcaaattcgatgacatctattacaacccaaagtatggacttgaagagagtttttatacatttattaaaggctgtaatttagatttagaattaaaaacaaaaaaaaatcttttaatagcggagttaggatttggaacaggattaaactttatatgtcttttaaaattcataaaagaaaacaatataacttcaaagattaattattattctatagaaaaatttccacttcaaaaaaaaacaataatgaaaatttcaaagttattcgttaaagaaaccgtttatttcaaattaatgttaaaacattatcctaaaattccaaaaaaaaatttaaaactaaaaataacagaaaatgttaatttaaaaattttaattggaaacgctaacataaaaattaaagaaattccaaaaaatgtagaatattggtttttagatggatttaatcctaaaaaaaatcctaaaatgtggaataatgaaatatttactttaatttctgagaaaagcagcccgggatgcaagctttcaacattttcttctgcaagaattgtaaaagatggcttaaaacttgccaatttcaaatatatccacatagaaaaaggatttggaaataaaagacatatgataaaagctcaaaaaaat

SEQ ID NO: 68 - DNA, 1989 bp, Borrelia afzelii
atgaaaaaaatgttactaatctttagtttttttcttgtttttttaaatggatttcctcttaatgcaagggaagttgataaggaaaaattaaaggactttgttaatatggatcttgaatttgttaattacaagggtccttatgattctacaaatacatatgaacaaatagtaggtattggggagtttttagcaaggccgttgatcaattccaatagtaattcaagttattatggtaaatattttgttaatagatttattgacgatcaagataaaaaagcaagtgttgatattttttctattggtagtaagtcagagcttgatagtatattaaatctaagaagaattcttacagggtatttaatgaagtcttttgattatgagaggtctagtgcggaattaattgctaaagctattacaatatataatgctgtttatagaggagatttagattattacaaagagttttatattgaggcttctttgaagtctttgactaaagaaaatgcaggtctttctagggtgtacagtcaatgggctgggaagacacaaatatttattcctcttaaaaagaatattttatctggaaatgttgagtctgacattgatattgatagtttggttacagataaggtggtggcagctcttttaagtgagaatgaatcaggtgttaactttgcaagagatattacagacattcaaggcgaaactcataaagcagatcaagataaaattgatattgaattagataatgttcatgaaagtgattccaatataacagaaactattgagaatttaagggatcagcttgaaaaagctacagatgaagagcataaaaaagagattgaaagtcaggttgatgctaaaaagaaacaaaaggaagaattagataaaaaggcaattgatcttgataaagctcaacaaaaattagattttgctgaagataatctagatattcaaagggatactgttagagagaagcttcaagagaatattaacgagactaataaggaaaagaatttaccaaagcctggtgatgtaagttctcctaaggttgataagcagttgcagataaaagagagtctagaagatttgcaagagcagcttaaagaagctagtgatgaaaatcaaaaaagagaaatagaaaagcaaattgaaatcaaaaaaaatgatgaagaacttttaaaaaataaagatcataaagcattagatcttaagcaagaattaaattctaaagcttctagtaaagaaaaaattgaaggcgaagaagaggataaagaattagatagtaaaaaaaaattagagcctgtttctgaggctgataaagtagataaaatttccaagtctaacaacaatgaggttagtaaattatccccgttagatgagccttcttatagcgacattgattcgaaagagggtgtagataacaaagatgttgatttgcaaaaaactaaaccccaagttgaaagtcaacctacttcgttaaatgaagatttgattgatgtgtctatagattccagtaatcctgtctttttagaggttatcgatccgattacaaatttaggaacgcttcaacttattgatttgaataccggtgttagacttaaagaaagtgctcaacaaggtattcagcgatatggaatttatgaacgtgaaaaagatttggttgttattaaaatagattcaggaaaagctaagcttcagatacttgataaactcgagaatttaaaagtgatatcagagtctaattttgagattaataaaaattcatctctttatgttgactctagaatgattttagtagttgttaaggacgatagtaatgcttggagattggctaaattttctcctaaaaatttagatgaatttattctgtcagaaaataaaattttgccttttactagctttgctgtgagaaagaattttatttatttgcaagatgaacttaaaagcttagttactttagatgtaaatactttaaagaaagttaaa

SEQ ID NO: 69 - DNA, 1068 bp, Borrelia afzelii
ttggacttgttagatttaccagaaaaagaaaagcaaattaagattaaaggagtgtttatgacaaaaccaaaaatattctcaatcactaaagaaaaaataaaaatatttttaataatagtgctaacatctacattcttattgggaataattttttcaaatgaaaacaaagtagcaaggatcctggaagaaaaatttttcgattttgacttaaatttaatttctaaaattgaaacagaatttgaaggaacactaacaaaacttgacaaagattgggtgctaacatacaacaaacaaaatattcccgttgataataaaaaagtcaattctctaatcaaagcattagacgaacttcaaaaaaataaacttgtaagtagagatcaaaaaaaacacaaagaactgggaattgaggaaaacccaagctttaaattatttgacaacaacaacaaactgttaacagaaatttttgttggaaaaccaggagaaggcgattcaagattagcatacattaaaggtagtgacgaaaatgtttacttaacaaaaaatattttcttatcgtataaaggaaattcttataatacattttcagatactgcattatttcaagaaaaaaacacaaaattagaaaatttatcatttaaaatgataagaaaattaaacaaagaaaatgaaaataatataaataatgactatgagattaccactaaagatggcctttattttttaaataaccaaaaaataacaaaagaaaggcctttaaatattattgccgaatttaaagctgatggacttgaaattgataaatctaaaatagatgactacagacttcaatacaagattgaagtcaagtggagcaataaaagtgttaacaatattgaagtttactttaataaaaacgaagaaaatgacaaagacatattaatcaaaaaagataaagacgaatattactatatgactagcaaatggactttttttgatgtatttaacttagaaaaaaaattaatagaaaaagataacatttctagtaatgataatcaagaagatcaccatgagcataacaacaacacagat

SEQ ID NO: 70 - DNA, 927 bp, Borrelia afzelii
atgataaatgtagaaaaagttactaaaatgtatggttcatttacagcgctatttaatgttagctttaaagttgaagaaggcgaagtgcttggcatacttggtccaaacggagcaggaaagtcaacattaatcaaaatcttaacatcatttcattatccaaacaaaggtaatgtaaaaatttttggaaaagacattgtagagcattcaaaagaaatactacaacaaataggatatgttcctgaaaaactagctctttatccagaactttctgttaaagaatatttaaagtttatatcagaaataaagggtgttaaaaaatttaaaaaagaaattgataaggtaataaccatatttaaattaaaagaagttgaagataagctaatttctcaactttcaaaaggatttaaacaaagagtaggaatagctggtgctttaataaatagtcctaaacttgtaatacttgatgaaccaacaaatggtcttgatccaaatcaaataattgaatttaaagaattcttaaaagaactagcaaaagaaagtacaatattattctcttcacacatactaagtgaagtagaatctatttgtaaaagaataattattgtcaacaacggaataattgttgctgatgacacaaaagaaaatattattaaaaataagcttaaagagattgaaatagaattaatagttttaaaaaaatctgaaaatgaaaaaaaatttttcaacagtaaaaatgatatttttacattaatgcaacttgaagaacaagagaaagacttaaaaatttcattaaaactatctcaaggcaaaacagaagaagatctttttaactacatagtaaaaaataatataatcttaaaagcaatgatcccaaaacatgaaagccttgaaaagatatttagcaaattaactaaggagagagaaaaa

SEQ ID NO: 71 - DNA, 327 bp, Borrelia afzelii
atggaactaaatgaataccaagaaaaagcaaaaaaaactgctaagtacaaaaataaaaaagaagaattaattttaacaacacttggtcttgctggtgaaactggagaagttgttgaaaaaataaaaaaattaggaagagacaaaaattacatcattgacgatgagtatttaatatcaattaaaaaagagcttggggacgttttatggtacttatcaactttaagcaataatttaggcattacgcttgaagatgtagcccttacaaatttaaaaaaaatacaaaagcgccatgaaaatggaacaataaatggtgagggtgatgacaga

SEQ ID NO: 72 - DNA, 1044 bp, Borrelia afzelii
atgacaatacttccaaagattgccaaagatataataaacgcatatgatcaaaaaatattgccaaatgcaattcttttactaggagaaaagttttcatcaaaaaagatcagcgcaattgagcttgcaaaaaaaatattaaacgaaaaaaatttaacaaaccccaatttgctcattttctcgaatctggatacaatagaagcaaaagcacatctttctgcagattcatataagatagcaaacaaatacttagaatatattaaaactgtaatttttacaaaatgttatttcagtaatgaaaaaaatttaaaaaaaatagagaaaaatatcaactacattaattctgtttattataaaaaagaatataatataaacataaaaaatgagcttataaaaaatatagaaaatataaacaaagagctaaatcatagtattaatgttcatgatgtaaaaaaaattcaaacttggattttttctgaaaaagaaaaatcaaaggtaatctacataaacgaaattgaaaatttatcatttaatgtacacaactcacttttaaaaatattagaagagcctccttcaaatatttactttatcttagcagcaagaaataaaaacaaaatacctaaaacaatactttcaagacttagaatctacaatttcacaaaaccagaaaaaaagttaggaattcaaaggttcaaagaaagctttctaatagataaagatataacaattgaggaatatttcgcttcattttacaaagaagaaagcaaaaaaataaaaaaagaattgacaaaaattttaaatataataaaagaaaaaaaatccatatttaatcttgaagaaatcgactttataaaagatgatcaaagttttaaaatatttttaaacgaactttcaattaacattagaaaagattttttagaaaacaagataaatattaatcaatatctcaaatacacagaacatttgaaaaatatttacagatatcgcccttataatcaaaataaaaaattaataatagaaaacttaatgctaaattacgaagagata

SEQ ID NO: 73 - DNA, 1008 bp, Borrelia afzelii
atgaacaaactaatgttaatgttaattacatttgctacaagtctattggcccaaacaaacgaaacttcaacaggactaaaagcagaacaatcatttaacaataacctgtctgaaagcgtgaaattaacagaaattgcggatatttgtcccacaaacacaatttttttaacgggtactggaatagtagtgggtcttcacgaaaaaggagactccctaaagcaaaaagaccttataagtaaaattttagaagaaaacaatacaatagatgaaataagccttaataacatagaaagcaaaaacattgcactagtaaatgttagtcttcaaataaaaggtaatacaattaaaggctcaaaacataaagcctacattgtatcaatactagattcaaaagatttaacaaatggaatacttttaaaaacaaatcttaaaaataacgagaaagaaataatagcaattgcatcaggaattataaagaacaataacaaattaaaaggatatggacatacttctgaatacaccctagatagtgtaataataaatgagaatcaaaatattaactacggttataatataattcttaaaaaaggaaattatacactaataaatagaattcataaaatattgacctctaaaaaaatcaacaacaaaatcaaatcagatagcacaatagaaatagaagtaaaaaacataagcctattagaagagattgagaatattgaaatagaaactacccctaagatattaatagacaaaaaaaatggcattatcctagcaagtgaaaatgcaaaaatagggacgtttacattttctattgaaaaaaacgatcaaaatattttaaataataacaataaaacaacaattcaaataaattcaatgaaattaaacgaattcatattgaaaaattccaacaatcttagcaataaagaattaattcaaataattcaagctgcacaaaaaattaataaattaaatggagaacttatcttggaggaagttgatggaaac

SEQ ID NO: 74 - DNA, 1182 bp, Borrelia afzelii
ttgagaaaggatttaatttttttagttttaattgttttgataatagtgggcgtagtaattttttttattagaagttcaaaaaaagagctggtttactttgagcttaatacaaagagtaatattagttttttgtttctagtagaagatcttaacaaaaatcttgtaagtatgcaagaaatttttattaatataaaaacaggaaatcttggctttttagatattccaattcatactggatatgaagatttaaaaggcaatatatcttggtttaaagatctttataaaaaaaattcttttaataagtttttgtctaaaatttatacacaattatctcatgaatcagattattatattcgttttcaaaaagaaaattttgttaggcttattgattatttggggggggttagacttcttgttaaaaacccagtaaaagtttatagttttgaggattctattttaataccctctggtacttctaattttgatggcgataaatcttataattatttgagatattttaatgatgttaatcattttgaagagagaggcgagttttttaaagagttttttaaaaaacttctttttcaaatttcagattttggcattgaaaatgatattttttttaaaatatattccatgttagatactaacctttcagaggttgtttttaagtatattgttaaaaattataaaataaataatgataaaattatttctattaatattaaagggcaagaagagatttttaaggataatgataataatttgataaaggtggttttcccttattatggaggtgctattttaaaagaatcggtagataaattgaataaagaattgattaatgaaggctcggaagaggtagtaaagattgttgttttaaatggaacaaaagttgttggacttgcaaaaaaaacagcaaatatttttaattctttaaaatttaaagttttaaaatttggcaatgcagataaaaattcttataaaaataccttgattataaataattctgataatttagaaatggctgttagagttggagaggcaattaaagcctcaaatattaagccaatttctgaagttcaaactaaaagattattagagcttgataatcttgatattaatccggatgtaatagttgttttaggagatgattttgatggaagatatgttaaaagtaag

SEQ ID NO: 75 - DNA, 1917 bp, Borrelia afzelii
atgaatggcaataataatatgaataataatggaaaatctaataacaaaaagaaaaataaaaattggattttaggacttgttgttatttttttaatttcagcgatatttatgtcatatttcataaggggaggggaaagctataaaaatgttccttatagcacttttcagagttatttggacaatggactagttgagtctgtagtaataattgataaaaatttgattcaatttgttgtcaaaggttctaactttgcaaaatcctatttttctaccagtattccttatcttgatataaatctgctttcagagctaaaaagtaaaaaagttgagcttagctcaggaaaaagccaagcttctttgattggggttttattacaaactttgccgtggattttattttttattttctttttctttatatttcgtcaaactcaaggtggtggtggaaaagtttttacatttgggaaaagtaatgctcaaaagtatgaagctggaaagaataaaatcacatttaaagatgtagccggtcaagaagaggttaagcaagagcttcgtgaagttgttgaatttcttaaaaatccgaaaaaatttgaaaaaataggtgcaaaaattcctaaaggagtgcttttggttggctctccgggtactggtaaaactttgcttgccaaagccgttgctggtgaggctggagttagtttttttcacatgtcaggctcagattttgttgaaatgtttgttggagttggtgcaagtcgtgttagagatttatttgataatgctagaaaaaattccccatgcatcatttttattgatgagcttgatgctgttggtcgaagtcgtggtgcagggcttggtggtgggcatgatgaaagagaacaaacccttaatcaactattggtcgaaatggatggatttggaacgcatactaatgtaatcgttatggctgctacaaatcgtccagatgttcttgactctgctttgcttaggccagggcgatttgatagacaagtaacagtttctttgcctgatattaaggaaagagaagcaatattaaatattcattcttcaaaaacaaagctttcaaaagatattaatttacaggtaatagcaagagccactcctggagctagtggtgctgatcttgcaaatttaattaatgaaggagctttaatagctgcaaggaataatcaagatgaaattttaatgaaagatatggaagaggctagagataaaatattgatgggagttgcaaaaaaatctatgactatcactgacagacaaaagcttgagacggcttatcacgaggcaggtcatgctttgcttcattattatcttgaacacgctgatccattacataaggttactattattccaagaggcagagcgcttggtgttgcattttcgcttccaagggaagatagactttcgatcaataaacaccaaattcttgataaaataaagatatgttacggtggttatgctagcgagcaaataaatttaggcgttacaacagcaggtgttcaaaatgatttaatgcaagctactagtttagctaaaaaaatggttacggagtggggaatgggcgaagaagttgggccaatatttttagtagatgatgaagcacccatttttcttccaaaagagttttcaaagtctaaggcttattctgagaacactgctgataaagttgacagagaggtaaaaagaatacttgaagaatgtttaaaagaggcgtcagatattcttgtagagcataaggatcagcttgttaagcttgcaaaagaacttgttttaaaggagactttgacagacaaagaagtaagggagcttttgggttttgaagctagtaaagatgaatacgatttatttgcagtagattctactgcaaaggaagtaaagggggaagatacaaaaggt

SEQ ID NO: 76 - DNA, 4401 bp, Borrelia afzelii
atgaatttggagtttttgaaaaataagacatttttattgttgattttaccacttttagtttttgttttaataattttttccattaatctatttgttcaagttcaaatttattctgcaaagtttcttgttgtaaaatatcttgaatcaaaatttggctttaagattaaatatgataatatttcaccatattttttatcatccattaaaatcgacggtttagagctaagcttggatggaaaagataaaatattaatggatgttgttagggtagatttaaatctgtttaaattaattttaggcgatgaaaatattattttaaatgtttatgttaaagggagtaatttgaattttgatataaacgattttagtttatccgatgatttgagttctagcagcgcctattccgacaatggaaatgtaattttaaataaaattttaaattatctttatagactaaatattaatttagaaaatatcaatattaatattaagctcaataagcataatagttggttgaattttaaagttagaaatttttcattgagtactgtagatgaagattttttatttagttctgtagttgattttagtgctgttaaaaatttagaaatcaatttgccagctgaaagagttgatgatggagttttagattcaactttctattttgaaggaaaattcaaaaaaggttttgaggatggttatataaactttagtttttttgaacttaaaacgagttatttttctttgcttgagcaaggattccaaataaattattcaaaaggaaatttaaaaatttttaatttacaaagggagaattttgattttaatttaagttacgataaagctaatggttttattcgattggatgctttatttttcaatgttaatcttttgaattggattaagctaaacaaagactttgaaatttataaagattattttgatataagcttaaatggtcagttggcattttcttatgattttaaagataaagatgtaagatatgcaggaataatagattcttctttaaatgcagatactataggtaaagaaattcaaggtttgcaacttaaaatcaaagggaatgatagcattgtaagcgttgaaaatgcctttttaaagcttaaaaggggagttgtaaactataaaggttattattctttaaaggacttgcttccaataggacgtcttaactttaaatctgcaaaaattttaaactttaatgatttaaatgggtatttggattttaagaaagataaaaatattttttcggttaagtctgatagttttagtcttggaaatcttagttttcaagatttaagtttaaaaacttattttttaaaggataaaatttttgttgactatttgatttatttagaaaataaaaattctcaaatttctttaaaaggagatcttaatgatgaagaattttctttcaatttaggcattaaagagtttccgctactttttttaaaagaagttgttcctagttcttatttaataaattttttcccgaagactttattttcaggtaaatatttaaatttagtttctgattttaatttaaataaatttgattatcgtaagaatagattaaaaaaattcaatttcatagtattttcaaagttggataattttaaatttatgtttgatgctagtggagaaaaaaatttttacaaatcaaacaactttgatttgcagtacaatgattacaatttgcattctagcttgtttgttgagctatttgaaagtgggtttaatattagtacgaatttttcttatttggataaaaattatcctttaaattttaatgttaattttaaaaataagtttattgttgctgaatctcctcttggcataaaattagatttcaattattttgattctaaaataatttatacccttaatgttaatggttttaaggtttacaataaaacctctgatcttttgataaatataaattttcatgggaactatttagagcttaataatgatttgaaatttagaatagataagtttaatataataaaagcttctaaaatacccgcttataattttaattttgggtttaagggcttatatgaatatgataaattgtacatttctgatgttaaatttataaacaagctttcaaatttgcaaggatatggacaattcaatttaaaagataattttaatggtagtttaaatttattttctagtttaaattcagaacgatattttttaggagttaattccgatgaatatggaagttattttttacttaaatttcaagatttagatttttacaattttaattctttatcccttttagaagggaaggttaatggtaattttttgctaaattttaaaaataatgattttaaaaattattctttgagtggatatcttgaggctgataaattaactttattgggcattcctatgcagttttctctgaatttaggattattggacaataggcttaacatatatgatataaaagtcaagcgcaataaaaaagagtttcttactggtagtctaagatatgacttaggcagctctataggcgtatctaatatggtttttaatagcgacttattttcttataagtttaatgcaaattttagaaactttgaaagtagggatgaagagcgatttggagttttgaaaaccaaaacagagggtgaattttcctttagagatattaaatataaaaatgagtttttatctaatcttacggttgaatttagcaatgattttgaaaaatttaatatggcctcaattgattatgaccttattgatgttttataccattatggtaatggagaatatagctttattttaaaagattatttacctcttagttttaattcatcaggtaaaataattaaaaataaaattcttggaaatgtcagagatattaaatttgattcaaaaataatcactaaagattttttagattcacatcctttatttaatattgacaatcattttattctttatgatctttttttaaatggtgaatttgatattgatggggatttatataatcctaatattaatggaagtttaaatattcaaaaaggattaataagtactgagtatttaagggcttctagaaagtttggtggtgatagaactttagaaatatttgatatgccagttgaaattcaggataataaaatcatttttagtaatgagtttgccctggatcggtattccaaggtttttgtttctactagtttaaatttaaattttttaagtgatactattattgattattacaaaatagatattaatgtgactggcagaacaggagtccctattaagtttgacaaaattgctttaagctttacaggttatgctttaggcaatttttcaattgaaggaaatgccgatgaaattatgtttaaaggcattttaaatatttcaaatgcttgggtttattctcttgaaagttctattgttaatttattagtaaatcccttcaagcaagcaaaaagagcgcaaacagttgatattaatgttcgagattttgatattttgactcaccttgagataaattttgacagcggtgttacttttcactggccagatagtaatatttcgtttttacaagctactatttcaagaggggataagcttgtaataaaatctgatacaaaaaccgatgattttattcttaagggagatttaaatattgcaaatggttttgttaattataataataaaaaatttatctttaaaagtggtgcttatatatcctttaatgagagcagaattaagtttgatccatggataaaggcggaggctacaaatacaattaaagatagaaatgataaactgcttgttacaataggtattgatagtcctttgagtttatggaaaattgagtttatgtcttatccttctaggagtgaacaggagattaaatatttgctctcgggatcaacaatgggaggatctgagggaggattgcgatcggcagggactaatgctgctgaaatggcaattggaatagtaagtgatattgctcttgattttttaattcaacccattgaagattatatgcgttctgtattaaacttagacttgttgagtatcaagacggatatattaaagaattctattaatagtaatttttttaaaattgggaatcctacttttgttgatgttcttgataatacaagtgttaaggtaggaaaatattttgtcgagggtgtttttattagtggaggctttggttttttaaaagagcaaacgactcctttttcaaaggatttaaattttgttattaatttgggcattgagtttgattctccattttttttggttaattatgagtttgattacaattttatgaaaaaaggtttagatggaataggaaataatataggtatttcttggaaatttaaatat

SEQ ID NO: 77 - DNA, 531 bp, Borrelia afzelii
gtgttttttttgattttaccattgttttttttattgtcctttaatgttttttcgatagatgttattaaaataggcattgttgattttgatagaattgtgattgaagttttaaatcctcaattgaaagctaatcttgatcaaataaaaaataggtatcaagaacaaataaatgggttaaatttagaacttaagaatttaaaacagatgtatgataaatcaattgctgataatgacttagacaatgcaagatcttttggtaaccaatataatttaaaagttgatgagctaaagagagtgtctagtttagcaaagaataatttagagcagcaaagattggccaatattaatagtttaaataataatagtgaatctttaagtaaaatacttcatggtattcaatatgttgcagaaattaatgggttttctttgattatgaaaaaaaataatccatatattctttaccataacagtactgttgatataacagatgatgttattaagtatcttttagaaaagtataataaaaatcct

SEQ ID NO: 78 - DNA, 837 bp, Borrelia afzelii
atgttaaaaataatcttaaaaacattaacaaaaataattgctatttcgtgcctcatagtaggatgcaccagcttaccttatagccctccaaaacaaaatctaaattacttaatggagcttttgcctgacgcaaatttatatgcccatgtaaatttaattaaaaatagatctatttacaactctttaagccctaaatataaatccgctctagggcttataaatgatttatattttagctataaaaaagaaaataacgattttgctctactaataatgggcaattttccaaaagatattttctggggaattcatagaaatagaaatacagaatcaataggtaatatatttgcaagtccaaaatggaaacttaaaaattcaaacatatacattaccccgaacagagctagaaccagtattacaataaaccaaaaagataaaactttaaaagaacataatatactaacaacaaaatatattaaggaaatagaagaaaatgaaatgtttttttggattcaagattcaaaattactgctatcagaccaaatagcaagtagtaaaaatttaatcccttttagcagtggaaccctgtctataaacagactaaatcaaaatgaatatatttttaaatccctactccaaacaaataacccatcaatattaaaaatattgtcaaaaaaactaattccaactatcttgacaagcatgagcaatctcacaatatcaagccctgtaaaagccacaataaaagatcaaaatacagtagaaatagaatttaatattcaaaaatctagtgttgaaaactttatagcaaaactagcttcaaacattcaaaaaacc

SEQ ID NO: 79 - DNA, 936 bp, Borrelia afzelii
atgaaaaaaaatattttggcaaaatacatattaatattagtaagtttattatcatgtaatataagtgcccctaatgaattaggaaacaaaaaaacagaaaaaaaaggaggtgggggtgttttaggctttatagagaaaattcaagaagagagtatagaaggtgttaaacaacatatagaaaaaagagaaaaacaaacgatgcagacggcttctgtaaaacctgttaatgtaaatagaaatttcctatattatcctcaagaagaaataaagataaaagaagaagtgttaattccaagtactgatgaagaaaaaagagtagataaagcaattagcgatgggcgtcttgaatttgataaattagtttataacgaaaataagcttaaaaatgaatttgagcaattagaatctagttttaataacgtttatgataaaatctcaaaacttaaagatgcaatacaaacagaggcgcatattgtagaaagaataaaccatataataaaaacaagacctgaaaaaagagaatatcagaatagagtaaggcagaatcagtcagaagaacgagctctaattaatttgttcaatcaattattagaaaagagaggcgatattgaggaacttcatactcaattagatagcggacttagtgaaagagcatctgcaaaatacttttttgagcaatcccaaaaaactttaaaagatgccattactcagagagtaaaaagcgaacatagaagttggtcaagaagagaatatggtggtaatttgacaagaaaggcaaatcgtgaaatagataatgctttagaacaattaaaaacttcttcttctaagataattaaagcaatggaaataaaggaaaggatagaacaacttcttcaagaagtaaaatcttttctagcttcttcaagaagcaaaatctgctttcatgagatagatttg

SEQ ID NO: 80 - DNA, 519 bp, Borrelia afzelii
ttgaaaaaaacgattattatatttgccatattggcatttctgtttaattgtacaaacaaagataatgataccaccaagctaaataatggtgcggaggaagactctcaaacactacaatctaaatcagatttagttgatgaagatagaattgaatttagcaaaacaacacctttagaaaagttaataagcaaattaaatttaaattctactgaaaaagaaacactaacatttttgacaaacttattaaaagaaaaactattagatccaaatgctggttcaaattttaaaaataccggtggggatgagagcaaaatagaagaggctatacatcaatttctatcagatctgaaagaagatgaaataaaagaaatgcttgcaaaaattaaagaaaataaagacaaaaaagaagaaaattctgaagagttaaatacttataaaaccatacttgctagtggattcgatggaatttttaataaagcagattcaaaaactgtattaaataatcttaaagacgctgta

SEQ ID NO: 81 - DNA, 840 bp, Borrelia afzelii
ttgaaaatagtcattatattcgtcgtggttttaattcttggttgttctttagataataattcaaaaatggagaatgagggtggcggttttaaagaaaatggattagatagactaggtcaagaaaaaagggctttaggttcatcgaattttaggtcattgttagatgattctggggtgggatccaattttcaaaattatgagcctttaaaagcgcttgagaataaaaataaatttattaattacaaccaaatagagtttttagaaggaacaaaatcagtcaatttgtatctttggtcgacttatattcgctgggtgaaaattaaagccagagatttgtgtgatgagcgtggaaattgtattaaagagcttaatggcattaagtattcttatcttgtttctcctattgatggaagctacatttcttatgctatgcctttaataatttttgaaactactagtgaaagtgatcctttttattctgtttctggatttaaattaataaacaaaggaagcgatataaattttaatgacaataaggggggatttttagggagaatcccaatgtctgaaaaatcagttgaatctgggcttgtaactgcgtatccttttggttctagtgattctaaaagagtggttgaggcttttactgccctttataataatggaatttggaacgatatgattgccgagattaccattaagtctaagaaccctccacaaaatgaaaaagtttacagaatttcacttgattctaagctttttaatgttactatgaaaaaaataattgaaaaatatcctaatataaaaaatacaagcttaacatttaattcgttgattaac

SEQ ID NO: 82 - DNA, 543 bp, Borrelia afzelii
gtggatataaagataaataaaaggaatttatctgagagtgttagagaagaagaacaagcgcttattcattataataagcttaaagaaaaattaaatattaattttcaaaaagaaatttattgtaaactagaagcaatgaaggttttaaaagaaattaaagataaagaatattataggctagacaactattctaattttgatgattttgcaaaagactataggcttgctagaactcaaacatataagtatctaaaaattgcaacagcaatagaagaaggtttgattgaagaaaagtatgtagttaaaaacgggattaatgagacaatttgtttacttaaaacaaaagaaagtccgagtttaaaaaaatctacccaaaatccaataaaaccactaagatttcagctcaaaaaggaagaatcttattctttttataaaaaaaatgctaagcttacgagctttcttttagaaaaaatttttttcgaagaaaaagattttttattaaaaataattaacgaatttgaaagttcaaggaataaacgaaaa

SEQ ID NO: 83 - DNA, 507 bp, Borrelia afzelii
atgattaaatataataaaattatacttacactaactttacttgctagcctgttagcagcatgtagtttaacaggaaaagctagattggaatcatcagttaaagacattacaaatgaaatagataaagctatacaagcagctaaagacgctggtgtaaatacagacgcgttcacagaaacacaaacaggtggcaaggtggcgggctctcaaataagagacgcaaaaaagctcgtcgctgacttaacaatcgaatttctaaaagcaacagaagaggaaactattacatttaaagaaaatggagcgggggaagatgaattcttaggaatatatgatttaatatacagaaccgcagaagcagtagaaaaaattgggatgaaagatatgaaacatacggttacacaggaagctgaaaaaactcctaaaactacagctgatgggataattgcgattgtaaaagtaatgaaagcaaaagtggaaaacattagaaaaaaacaaactaaagataaa

SEQ ID NO: 84 - DNA, 1584 bp, Borrelia afzelii
atgaacaaaaaaaaaatcccacttttaacgctgttaattatatttgtaaactcgtgtacaatttctaaaacaaaagatgattttatctttggagttggaattggaaacgaaccaacaacacttgatccacagttttgtagtgataaatttggcactttaattataaatgaactatttattggacttttaagaggagatcctaaaacaggtggatacagaccaggacttgcaaaaaactgggaaatttctcacgataacacttgctatatatttcatttaagagacgacatttattggagtgatggtgttaaaataacagcagatactattaaaagctcatacataatggccttagaaactgaagagagcctgccaaatattagcctattaacatcaaaaataaaaaatgcaaaagaattttacgaaacaaaattaaatccagatgaagttggaataaaagtaattaatgagaaaactttagaaataactctttctcaaccaacaacatattttcttgatatacttacaaacccaatatttatacctgttcctatccatattattaaaaagtttggaaataaatggacaagcccagaaaacatggtcacaagcgggccttttaaactaaaaagaagaatcttaaacgaagaaatatctcttgaaaagaataaaaaattttatgatgctgcaaacgttgctattagtgagcttacatttgttactataaacgacgcacgcagaatttacagcatgtatgaacacaacgaaatagatgctatttttaacaacatccccttaagccttattaatgagcttatcttaagagaagacttttattcaactgacattaaccaaattgggtttctttcattaaacacaaatgttaaacctcttaacaatccaaaagtaagagaagcattgtctcttgcgattgacagagaaacattggtttacagagtgcttgataataactttaaagcaacaagaaaaatggttcctaatattaataattataattatgggaaaaaattaaaactatacaacccacgaaaagcagaaaaacttttagccgaagctggatatccggatggaaaaaaatttccaacccttacaataaaatataataaaaatgaccttagaaaggaaattgctaattttattcaaagccaatggaaaaaagttttaaatattgatatagaaactgagcctgaaacatggaataattacgtatcaaacattttaaaaggacagtatgagatctcaataaggtcctggcaaggagattatttagatcccatggcattctttaatatgtttgaaactgaaaacactcatttttcatcttacggatattcaaatcctgagcttaacgaactgataagtaaatctaagtttgaagtggatgaaaaaatcagattagaattgtttaaaaaggctgaagaaataattattgaaaatgattacccagtaattccaatatacagcgctgcgggaaactatctttttagaaatgataaatggacggggtggaacaccaacaattcagaaagatttgccctatcagaaataaaacctttagaagat

SEQ ID NO: 85 - DNA, 648 bp, Borrelia afzelii
atgaaaggaataagtattttatcattactattattggcattttcttgcaaacaatatggtagtgttaaggcactcacagaaattgcttctgattctggagataataattctcttgtcgttagtgataatttatcagctaaagagccgattgccgaaaaagggcctactttaacatcacaggaatctgaaagattagaggctttaaaaacctttttaaaagacgcaatgggtgttaatggaagagaagataatttaaaagccgagtacgagaaatcttataaagaattttttgattggctttctaaggatgttaacaagcaaaaagagtttgtaagttgttttaacaatatttgtggcattgttactaaagcagtagatgcagacaaacaaagacgtcatgatcaaaaatccctaggttttaatgaatatgtttgtcacaaaattaaaaatagcacaggtggagctttaagtttatttttccaaaaagtagctgatgcatttggtgctgaagagtacaaaaagaaagatgatgagagcagtcaaaagcctgagaaatgcaatgaagagattttcaaagtaatcaaaagagtgtttacagaaagtgatagtaataatgaattaaaaaatttaaaaaatcatggaaatatc

SEQ ID NO: 86 - DNA, 1197 bp, Borrelia afzelii
ttgaaagacaagcttattaaaattttaaacaaatttttaatgcttgcaccactgctgattattagctgtaatgctaatatgaatacaaatgacaaaaacaaagccttaaacgaatataaattacaaaatatttcagaagtcattaagaatagcttacaaattgaatcagactttaaaaaagaacttgaagcaaatataaataaaagtacccctcctattttagaaattgaaaaaattgaacttggaaaacaagaatttccattaaaatccgaatcaaacagcgaaatcttaatcccactagaagacacaaatatagccaaatcagaagaagaaattgcaaaaatacaagaaaaattattgttaatcggggctcctgatgaaattgcagagcaagaattagacccaaataaaaagcctttacatctaaccacaatagaattcaaaatttcaagcaacgccgaagagcaagaaatacttaatccaatcgaagaagagactaacattaatatcaaagacaaaatctttgaccaaaaagaagaaaatagcactttaaacgaaagtacaaaaacctctacacaaattcaattccaaaaacaaagcacatacttaagcgaagatggcaactttataacaaaagaatacgcagaacaagttagagaatctctagataaaacactaaatgcaataaaaaatttagaaacatccaaagatcttgagattgagaatgaaattgaaaatttatcaaaagagcaaagctctgcaaacacatcaaacaacacgtccgccaataatattaatactgagaatatagaaaaaacaaaaaataaattgcttgaaaagctcaaaaaaagtgaacttatttttgaagagactaaagatcctttaggaacaagtaccataaaacaagtcctggatgctgctaacaaatggcaagaacaagaaaactcaagccaaataaactgggacttaggatcaaagtttcatccaaacccaaagctttacaacaaatcagtagcccaggagtataaagttttggctgaaaaatttaccaaagtaaaaaatgaatacaaaaacacaaaagatcagctagaagttcactctaaattaacaaccagcaatatcagcaaaataattgacgcaacaaaagagtttacaagccaagtaagaaatttaatctcattagtagaaaatgcccac

SEQ ID NO: 87 - DNA, 879 bp, Borrelia afzelii
ttgaaaaaaaataccgtttataaaatattaaagctatttacaataaccttactattctcatgttctttttattctaaatcaaacaacacagaagcaataagtgaattacaacaaaactccattgaaattaaaaactctgggattgggaaaacagaaaatcttaaaaatattcaaaacttacaacaaaaccagctcctaaacaatgaaaaggaaatggtaattaaaaactttacacaaagattaaatgaaaatgaaaaattaattcaaaaaataggaccgaatatttctatatttgctccgaaaataaataaagatgttttaaaaatcgaacccattgatcaatttagaataaataaaaacacattcccggaaaatactcaaagtcatatacttaatttaacattaaaagataatcaaattagaagattattttattcatctctagattataatgaaaataaaatcaaaaaattgatctcaatacttgaacaagcatcaagctcaactggctaccattataatgttattggcttaattttttggacaggatttaaaacccaagaatcatttgaaaaagctgtcaatcttttaactaaaaacgaacaaagacgcctaatgtttaactttgatacaaaaacagtaaaagatattcaagaaaaatttgaaaaactaatgcaaaatagaaatgattggataaaaactgtagagaaaattattgacgaatatgacaacaatatagcaaatgtcaaagctgacggaatgattttaggagaaatgttaaggcttgaatacgaacataaattaaacccagatgaaagtatgcgaattgcaaatgatattgaaacattgctaaaagcctgttgtgaccacacacactac

SEQ ID NO: 88 - DNA, 1095 bp, Borrelia afzelii
atgaaagaaattggaatatctatataccctaatgtaagccctaaaaataaaattattgaatatcttgaaaaaagtgctcattttggatttactcaagtatttacctctttactctatattaacggaaatgaatttgacgtgttcaaagaattactcaatattgcaaataagaacggaatgaaacctattattgatgtaagtcctaatattttcaaagaattggaaattgatctttcaaatcttagaaattgtacaaaactagattattttaaaaaacttggtgcttgggcaatcagattagacaatacatttacaggcattgaagaatcattaatgactttcaacgattctgaccttaagattcaacttaatataagtaatataaataaacatattaatacaataatgtattttaagcctaatataaaaaatttgctcggatgtcataatttttatccccacaaatatacaggactttcaagaactttctttaaagaaacaacaaaaatatttaaacattattcaatcccaacagctgcattcattagttctaataatgcagaagaatgtgcacgaggaaaagaaaaagaaggcgttcctacactagaatcacacagatctaaagatatagaaacccaggcaaaagatcttttcaaagaaggaatagacactgtcctaatttctaattgttttccaagtgaaacagagctagaaaaagtatcaaaggtaaacagaaacgttttagagcttaaagcagacctaaatccaaaagcaactccagtggaaaaagaaataatactagaaaatttacattttaatagaggagatattaattcttatagaattcgatcaactatgccaagagtatactacaataataagaaatttcctgtacattccccaaatgaaatcaaaaaaggagacatattaatagactcttcaaaatatttgggttatgcgggagagcttcaaatatcgctaaaagataccccaaataatggtcttacaaacgtagttggaaaaatagtcagtgaagaattatatctgcttgaaaaaatagaaccttgggaaaaattcaaaataatagaaaataaa

SEQ ID NO: 89 - DNA, 1590 bp, Borrelia afzelii
atgaaagtattgataaaaaagttaaaagccgtattatttttcaatgtaatcttatttatttcttgtgttaaggaaaatgatgggcacaaattagtatttaagttaaatattggaagtgaacctgctactttagatgctcaattaataaacgatacagttggatcaaagattgtaagtcaaatgttccttggtattttagatggagatcccagaactgggggatataggcctggacttgctaaaagttgggatctttctaatgaaggactagtttatacatttcatttaagagataatcttgtttggagcgatggagttgctattactgctgaaggaataagaaaatcatatcttagaattttagataaagaaaccagctcgtctcttgttaacattattaagtctactataaaaaatgcagaagagtattttgatggtaaagtgaatgagtctgatcttggaattaaggctcttgatgagaaaactttagaaataacgttaaaatcaccaaagccatattttcttgatatgttagtacatcaaacgtttgttcctgtaccagttcacgttattgaaaagcatgggcaagagtggacaaatcctgagaatatggttgttagtggccctttcaaattaaaatctagagttttaaatgaaaaaattattcttgaaaagaataataaatattataaatctaaagatgttgttcttgacaatattatattttttattacagacaatagcattacagcttataatatgtatttaaatgatgaactagatgcaatttttaacaatattccacccgatttacttaaggatcttaagcttagagatgattattattcaataggcactaattcaacctatttttattctttgaataccaaagtaaaaccgcttgacaatgttgaagttagaaaggcgctatctcttgccattgataggaaaactttaacagagagcgttctgaatgatagttctattcctacaagaagagcaacgccagattatattgattactcttacaaaagcaatttaagcttatttgatgttgaaatggcaaagaagcttttagtggatgcgggatatcctaatggtaaaaattttcctttattgaaagtaaaatataatacaagtgataggcagagaaaaattgctgaatttattcaaaatcagtggaagaaaaatttaaatattaatgtccagcttgagaatgaagagtggtcaacatatataaatagtcgagtaaatggtaattatgaaataataagggcagggtggtcaggtgattatgctgatcctatgacattcttaagcatctttaaaactgaaaacacagctttttcatcttatggatattcaaattccgaatatgataaacttttaataaagtcagatcatgaaagtaatatttttgaaagacaagaaattctaaaaaaagcagaagcaataataattgaaagagattttccgggtatatttattaatataatttcttctagttatctttttaggaacgacaggtggaaaggttgggagccaaatatttcggaaagatttaatttatctgaaataaagccaattaaa

SEQ ID NO: 90 - DNA, 1209 bp, Borrelia afzelii
atgacaaacaagataataaaagaagctttaacttttgatgatgtgtctttaattccaagaaaatcctctatattacctagtgaggttagcttaaaaacacagttgacaaaaaacatatccttaaatataccatttttaagctcagccatggatactgttacagaaagccaaatggcaatagctattgctaaagaaggcggaatagggattatacataaaaatatgtcaatagagactcaaaaaaaagaaattgagaaagtaaaaacatataaagcccaaaaaaccatcaacactaataaggttacaaacgaacaagaaaccaaaatgcttacaaagcaatatttagaagaacccgaaatacataaaaatacagaacacaaagaagatttttctaatgcatgtaaagatttaaatagcaagctaagagtaggagctgctatttctattgatattgataccatagaacgagttgaagaacttgtaaaagcacatgtagatctgattgtcatagactctgcccacgggcattctacaagaataatagaacttgtaaaaacaattaaaaacaagtatccaaatttagaccttattgctggcaatatagtaactaaagaagccgcattagatttaatcaatgcaggagcagactgtttaaaagtaggaataggtccaggtagtatatgcacaacaagaatcgttgcaggagttggcgttccccaaataacagcaatctgcgacgtttatgaagtttgcaaaaacacaaatatttgcattatagcagacggtggaatccggttttcaggagatgtagttaaagccattgcagcaggagctgatagcgtaatgataggaaatctctttgcaggcgcgaaagaatctccttcagaggaaataatttacaatggaaagaaattcaaatcttacgttggaatgggttctatttccgctatgaaaaggggctctaaatcaagatattttcaactcgagaacaacgagcctaaaaaattagtccctgaaggaattgaaggtatggtaccgtattctggagaattaaaagatattttgaaccaactaaaaggtggattaatgtctggaatgggttatttaggagcaatcacaatatctgatttaaaaataaattctaagtttgtaaaaataagccattcttcattaaaagaatcgcatccacacgatgtttttaaaatgcca

SEQ ID NO: 91 - DNA, 636 bp, Borrelia afzelii
atgaaaaagaatacattaagtgcgatattaatgactttatttttatttatatcttgtaataattcagggaaaggtggagattctgcatctactaatcctgctgacgagtctgcgaaaggacctaatcttacagaaataagcaaaaaaattacagattctaatgcatttgtactggctgttaaagaagttgagactttggtttcatctatagatgaacttgctactaaagctattggtaaaaaaatacaacaaaataatggtttaggcgccaatgcggataaaaacggatcattgttagcaggagcttatgcaatatcaaccctaataacagaaaaattaaaggcattgaaaaattcaggagaattaaaggcaaaaattgaagatgctaagaaatgttctgaagattttactaaaaaactagctgctgggcatgcacagcttggtatagacggagctactgataatgattcaaaagaagcaattttgaaaacaaatgggactaaaactaagggtgctgaagaacttgtaaagttatctgaatcagtagcaagcttgtcaaaagcggctcaagaagcatcagctaattcagttaaagagcttacaagtcctgttgtagcagaaactccaaaaaaacct

SEQ ID NO: 92 - DNA, 1092 bp, Borrelia afzelii
atgaaagattttttaaccaacacaaaaagtccaaattgctacaataagcatcaacataaattaatagtccttatctcaactttaaagtatgtaaacaaaaaatataaaaaatacactcaacaaaacatactctattactttaatgaaaatctaaaaagaaatggtcaaaatcccgttaagttaaagacacttcaaaaatatctttacgaattagaaaaaaaatttaaagtaacaactaattattacaaacacttggggataaattgtggtactgaaatttactacaaacttaattatccaaaaaaagagtgtcactatatgataaacaaatacttcaaagacaaaaaacattctagatttgaaaaaagagctgaaataggccttaaagacaaatttaataaaaataggtgtgtaaatttggaggagtgtttaagtaataaaaataataatataaaagaagaaaagaataaacagatagaaaagtttcaaataataaaatattccaataaatgtaactttaaatgtaaagaaattcttccttttattttatatttagatattaataaagacttgaaaattaaaatgcttaaagtctcaaaaataattgagattaaactactaaagcataaaaatatacattttaataaatcttgctttaaagataagcaaaacaaattaaaagaaattctaaaaaatacaaaaaaacaattagaaaaaaaaggatacaatcctgaacaattggaaacagaatttaaaaaaatatatgaaaattacaaattaaaaccccattttatcatcgaatatcaaaaatatgatgatttaagcaaaataaagcgcaaattagaaaaatcaattgaattaaaaaaagaaaacccacaaaaagattatgaacatataaaaacaaacattttcaatatactcattgaacaactaaaagaaaaggcaaatattgaatttataaagccaattataaaaacatatttgaatagcaaaaagaaattagaatataataaagtatttgatatatataattgcgaattattagaactaataaaaaatgaaaataattctttgatgttaaaagaagttgta

SEQ ID NO: 93 - DNA, 3243 bp, Borrelia afzelii
atgaaacttgatgaaataataattccgctatcaatgtcgatcagcaacaatcaaaagctggactcaatagcagaaactctaaaaaaaattgccgagcaaaaatttgcaagtctagataatttgaagtcaaaattagaaaaatctactgcatctggatcaaatttggaaaaagctttgaataaaagctcgcagaacgctagtaaaaacttcaagtctcttgcaaattctgtcgattctgtaaattccaaagctagtggtatgaaaagtataggcaaagttctgaaaagtgttgggaaaggcttaggaagtgtaaagaatttggcaaacaaaactggtgaagcattcaaccaaatgttggcagcttttgccccaattattatagctgtaaaggctctacaagcaattggctccacaataagtggaattttcgatggcgctatggatgctcttgatgaatttaacgaagaagtgtcaacgttttctgacatgcttggaaatgaagaacttggaaaatctttagcagaatccatgagggcttttggcgatgaaactctttttactagagacgctattgctaatgctactaaaacaatgctttcttatggtgcaactgcgagtgaagttgaagagagaattagaatgtttggggaggcagctggtggaagtagcgaggggcttgagaaattagcagaagtatattctcgtgtagaatctagtaatcaagtaaatttagaagatttgtatgcgcttcgtgacgctggtgttgatattacagacattttagcagaagaagctggtttagctggagaggcattatataaggccgcgagcgatggacaaatagggttcgaagccttaaataaggctctttctaaggctactagcgaaggtggtaaattttacggaaacaccgctaaagaagcaaaaactttatcccaagctcaacaacaaactgctaaaatgagcgaaaagcttttcttagatattgggaaagctttagagccaatgatgattggatttgaaaaagtaaaacagtttcttctggtggcgatcatggttcctttgaccaaagtgactacagcgacaatatacttaactaccaaattgggtgaacttgtggtatatctttccggcaagtggttggaaggtgtaaaaatgtggttcaaggcaatctccacaccctttgtcaaattgtttgaaggaatcaagtacgtattcaacaagctaaaagaacttgcaaaatatgtttctagtgtattcccagagcgtttcaaaagtgcattcgaaccgatcattaaatggtttcaaaaattgctggatatggcgtccaaagcatacgaaaaattcaaaaatattattactttttggaagaaatcaaaaaaggaagaagatactcccagctccgaacccgagagggacaaaaaggttgatccaaatgcaaaaaccgattacaacaaaaagattgagcaagactataagaaattgcaagacgaaatattttttgcccaaagggaaatttacagtaaagtcggcgtggagcgagaaaaagccttaagggagcttgaaaaaaccatcaagaagaaaaaccaaaagtttctaaatacgtactccaaaagatttgatgagttatcggacgagaacaagaaaattttagtcggggttgaaaaagcagtaaacgaattcaataattctaattatgattttgtgaatgagtatcaagaattactaaaagaaaaagaaagtcgtgaaagaaaaatactattaaccctaccccatacagatcaagaaagcgctttacagaaactgaatgacgaaatcaatggaaagaacaaagcgttcgtagaaaaatatggaaaaagcttcgaaactctgaacgagtccaacagaaaaattgtagccgaacttgaaaagaaagttaaggaatttgaaaaagctgctttagatcgatcttttgtcgaggctcaaaaagctctacaaaaaaacatactagccttagagtgggaaacaatgctacttccagcaaaagaaagagcaagtgctgaaaaaaagatggcatccgacattcaagcaatgtacaagaaattcgtggatgagcacaaatcgcaattcgacaatctaaatgaaaccaacagaaacgcactaaaacaaatggctgagaaagctaaagatactgcaaaaagcttatatgacaaatgtttagaaaatctagataaatttacggaatttacaggcaaaattttgaatcaggaagtgggagaaaaagccggttctgaaggctttgattatgctgcagacagtgcaacaaaggggttggttgattttgggaaaaatacgttgaaagctgttggagcatcttttggacctgtgggccaagctattgcagaaattgtcatacaaatcggagagttcctatggggatggttcaagggtgccgaaaaggccagaattaaaaaaattgaagaacaacgagataaagatttagaagaacttgaaaaacgaagcgaaattgaactaaagaagcttgaagagaaatttgatgcagaaattgcaatgagaaaagaaaaattgagtgaattagatgatgaatactctaaagaaatagagtttctaaaacaagcacaaagtaaaggccaaatatctggtgaagaatttcaaaaaagattacacgatgtacaaacagaatataaaacaaaaaaaggcatagaaaccaccaaacttactaaagtcgaagagactaaaaaactagaagtggaacgacaaaataaattttccaaactagaaaccgagcgaataaaagcacaagccgaagttgataaggtaaatactcgtatgtggtcttggtccaagtcttccgatttagaaaaggcacagaaaattttagacgaaatactaaaaagaattgcaacagtaaaatcggccggatctattgaagagataaaacttgctcgtggcggtgcacgatttgtttcaaataaaccgacatatatgccaaactcaggtgtaatgtctagtgaatttggccaacccgaattggtaagaatcactcctgcaccaatagatgaaaatctacgcaaacttgaagctaaaattattgcagaagaaattgccaaattacaaaaaagccaaagcagtacagttgtaaataatttttactataacttcaatggggatgtgcttgatgctgaaaaattagttagaatgctaaaatcaaaagaacatctaatgacatttcgaatggctgaa

SEQ ID NO: 94 - DNA, 426 bp, Borrelia afzelii
atggtaattaatgttaatttgactggcaaggtaatgttgccctatatcccagactatattagaaacagcaaggaaaagatcaaagaagaagagaaagcatatgtggttttgaaagacattaactacgggtttgtggaaaagctaaaagcaagacaaatcgaacttttcaaaaaattgaatggcgagaatggtaaaaccaattccaatgctatgattgagtcaacaagcgctcaaattcaattcgtaaaaaaaatttgggatgaaaatgtggtagaatttgtcggccttgaaaatcaacaaggagaagttatcactaaagagatggttgaaagtgacggtatcttgtttcaagacatgctttcaagtcttgcaatcgaaattaatttcctggcagatactctaagggttgagcgtgtttcaaaaaag

SEQ ID NO: 95 - DNA, 1188 bp, Borrelia afzelii
atgagactaaggcgactcccaatatacgttaatgcttataaagaaaaacctaatgctgaaattttcatatattactccagtagaggaactggtaaaacttatgatattgcaactgtcaacttagaaagaaaatttagcgttgatggaggagatacacttgcaataagaaaaaagaaaaacaaaacaacacaatcaatacacaaagaaattttagaacttttgagcatatatggcttaagaaaatttttcaatataagcaaagcaaaaattgagagtaaaagtttgatttttgggaaaaaacgagcctttgttttcgaaggaggccacgacacaagagatttgaaatcttatgcgcatttcaaagacttatggctagaagaagccaatcagtttagctccgacgatatagaaatgcttatccctacaatgagagaacaaggtggcagaatctatatgtcaagcaatccggtacccaagtcacattggctatacaaaagatacttggcaaatcaagacaatcccgctgtttgtattatcaaaagtacctatcgagacaacccatttttgaacggcggtgatgttgaagcttggcttgaaaaacaaaaacttgcatatcatggaaatgacattggatttagaattgaagttttaggagaagagtttgatttcggcactgcaagattaatcaaaaaattcaatgtttgtgaacccagtcttatttccagagctaatggcagctactacacaggggtacacatcaagggaaatagaatttgttttttagaaattcttgttggaagaatttcgtatcttccagttgtaattgttacaaacgcatgtagcaaagtgttactatcaaaagctgattatcaagctgaaattaacaatttcaagggcacttttgttcttccggctgctagagaagaactcaaatatgtattctctcgttttggtagaggcactttgcttgcaaaaaaacgaaatttgtattcactctcggattatttgataccggctaatcttagtgtagtaaacatacccgaaacaaatgatgtaatttcagagttcaacgaaactgaatattactatgatgaatctagtgcagaagacagcgaagttacaaattttgttatgcaaaaagatttgacgtacatcccggcatttctcaacgctgcatctatttttaac

SEQ ID NO: 96 - DNA, 780 bp, Borrelia afzelii
atgataagtgatgaagactttgaagaaatcaaaaaaagacttcaagccgacaacatcaaattccaatttggcgttggaactatggaagaagcaaaaaattatgttggcaaacttggcgaacccattgttgtcaaagacaaagaattatttgccatttgcaatggccaaaacactactaacagaaaatattactccctaaataagaatactaaaccccctattggtgaaaatctagaagattatctagaacatttagttaactggtgcttagaaaacacttacccagggtttttgaccgctgagtttgccaaagaaggaacactctcaagaagtaagctggtaaaagctttcgaagatactaaaaaattttgtattccagatggcagaagtcttcctgaaagttgttttgtaaaagaaaaatttggaatatcttcagcacccaatttgtcgggtagattcctacgacattacgattctggtggttacactgattctgatggttcaagaagcttgggcggtacacaagagcattctttggaaaaacattctcaccccatcgacataagcgatttgaagaaactgaaggggcgacttataaatgattactactacattagaagagattctaattggtctagtggctcaaccagttttcttacaggtatagtttacggcgacggtatatactattggaattaccctttcaaaacagaggatatgggaggtaatgaaactaggccaaaaaatacctgttacatatcattttacaggtacgattgg

SEQ ID NO: 97 - DNA, 2622 bp, Borrelia afzelii
ttggaagaacaagataatacagtccaaggaattgacttggaaagtccagaaattactggccaaaatccagaaatatcaagtgccaaagaagatacaacacaagattgtacttctttggggtttgacattgtattctacacggatgaaggtcaaatttttgaacttaccccttttgtagatatttcaagcattgtattagaagaaaaaatagtagacccaagcttaaaaacagcatcaagcaatttcagcttcagcgtaagtggcctatcagaagattttttgaatttcttatttttcagaaacgaagatattttcgtaaaagtaagcgacaacaaaaaccccgtatttacaggaattttagaaaaatttttcagcagagatttgttcaatagcaccaaaagtgtatcgttcacggtcaatgactactctagcctactaaagattgcattcgaaaatccagttcaattcccaatcaatttttcaccagactggcttttcgtatacaatcctttggcaaaagagctctcacttgtccacctaataataggaaaaactaaactgaaagaccttattgatgatgatgctagcgaagcaatacttgacaaagtccccgctgtaatcattgattgtggagaaaatgtagaaactattttacaagccttgctttacgaatttggatacgcatacactttctctccaattggtaaactaaaaattcttccaatttggaaaagtgaagtaatcaacagagaaattgaaatttgtactatagatgccgaaagttatgttatgtcaaaaagtagctccagtagctacgattcaactaaagttatttggagagaaggcaaattccaaagcaaagaagaatcaatatccaaaaaacgaccactctactcagcaccaatcaatgttgctggtaatgatggcaaactttacgttgcagttcttcaaaaaggcgtagtgtaccccgactttgcagacaaagtcggcagcagtgtttttcaagaatacgaccctagttggctagacacagtttacaaatgggacttcaaaaggcgtgaagtttggcacgaccactacgccataaatgaacatttagcaataatctcaactcataaccttgaagcaaggtttagtgccgactcctccatcaagcttgaaaataaagaatattttccaacaaaggctaaactttggtttagaaacacttctagtagtcaaggctccaaatatatttaccactttgatatctacggagatgttttctacacaatagctcaaaatgtaattcaaactgacaatgctgatgatttttactctaaaaagtttgaatacacaaccaggttcattttttccgaagaatccgcagtaagactttttgaattcctaacaaacttacgtgtcaaaggacacactattgttaattttaggtcaatgcaaaatctaaacataaccgattttgtcaaacttagacctgacaatattgggattgatcattttttccttatactttcaaaaaaaattactaactttgatctagatatcaagctttacgaatacgaaggaatcacctggggtgactacactcattacgaataccttacaacttcaactaaaatatcagtaagcgactacttgtctggggtcaacaaagttgttattgcaccgtttaattacaatggcgctgaaactttccagttcaaagctgacggattcaaagacgaagatactctaaacaccgcaattgaatttgcaaaacaagcaggacttaacaaaatcaaactcctcaacggagatttttacatttacgatcaagtaaacctaaacaatttggaaatccaaggcaaagacgaagtgacaataagaagtacggggttttcaaaacatatttttacatcagaaaaatcattcaagctttccgggattagcatatgccagcagccattaagcgagctctacattaacggaggcactctaaatcaagaagaattgtcaatgtacctagaagacaaaagctttacacatccccatggtgtagtcttctgctcttcatattcagtaaaagaaaatgccagatcatcagtctatgttacagatgtaaattttgtgtacatcaaagatgtcacatttcgttgtgctctaaacaatgcactgtatttgaaaaaagtaaaaaaaatcctgctagaagatgttgattttgactctgcaaaccaaggtttcgaaatcagtgacgctaaaaatattacgctcgtcaacaccaacatcaaaagcagcaaaaaagaatcggttgcaagcggatacaacattatgatcagggaaagttcttttgaaaacaacaacaatgcactaaaactttcgaatttctcaagcgtaaaaatactagattctcagctcagtaaaaacaaaggtacagcacttcacttagttgacattactatcgcaagactaaacaataatgtttttgtcgaaaacaaagtcggacttgaaaatcattcttttgacttaatcattcaagacacttttttgaaaaacacacttgctcttgatctatcagattcaaaaggaagaataattgatagtagcacttattcagaaaatactaaagacaaacagggggccgct

SEQ ID NO: 98 - DNA, 411 bp, Borrelia afzelii
ttggctttaggaggtaaaatgaaaataagaatgaaacatttagtaagaagactttacttgagaagggacaaaatttggcatgtttacatgagcacggaaattcaaaacaaagctaaggacaaatccattaccaattttcccaatttgaaaccagaagatttggactacgagtacgtttacaagttcttggatgagtggattcagaagaaatacaacgctaataaactgggatttactattgagaaggtagatggtcttgaatatatttgtaaggcaaaaagatatgctagtcttaagaagatattaaccaaaatttttaaagattataaagatatatttcttggtaggttgcagaaggctcctggtgttgcggcagttcccggatcgacaggtaaggggcaaggtggaagt

SEQ ID NO: 99 - DNA, 600 bp, Borrelia afzelii
atgaaagtagcgttgacaacaaatactactgaagaacaaatatataaagaatttttgcgactagggatggagcaattaatagcacaagatttatcaaaaagatattatcataatgtgcttacatatagagatttggaaaatttagaaaaacaatttggaataaagtttgataatcttatttctgaaatttcttttgtagagaaaaatttagatactaagattgatggtataaaaaatgagcttaatgccaaaatagatggtttaagtatcaaagtagataacctggacgccaagattgatactgtagagaagaatttgcaaaaagacatgtctaatttggcacaagatctacgaaaagatatgtctaatttggcacaagatctacgaaaagatatgtctaatttggcacaagatctacgaaaagatatgtctaatttggcacaagatctacgaaaagatattcaaattaatagtaaattattatcggaaaaactcaaggtaagcaacagaataataattcttattacagtattagtagttcctattgctatatctagtatggcaaatattgttatgtcgataattgacagctatctcaaa

SEQ ID NO: 100 - DNA, 3834 bp, Borrelia afzelii
atgaaaactaataacattgtaaaaacaaatgatctaaatatatctctttataaagaactatcagaagattttattaaaaaagagaatattaataaactaaaagacttttttattcttataaaaaataaactttcttcaatagatgataattcaacagaagcaaatatagaggctttattaagatctatatttgaaaaactaaattattcagtagaacaacaaaaaggtgggcaaatagaaggagtggattctagagtagatatactacttttcgaaaatgataaagacaaagtagattttaataataaattagaagaagctaaaaaaaataatgagcctattccagccgaagatatcttacttatagtagaagttaagcgtccatcatttagttttaatactaaagataaagtaaaagaagcagaagatcagctatatagatatctaaatcaatatcaaaaacattatgggatgctttcaaatggaaaagtgtggagattatatgacaaatctaaagtcctttatggagaaaaaagatatattgaatttgatttttctaaagttgaagaaaaagaagaatacaaagaacaagaatggtttgttttattcatctaccttataagaaaagaaagatacctaaagacaagcaatgtaatagagattgaaaaagaacaaatatctaaagaaaaagagataattcaaaaaactcttagagagatactttatgagaagcctgacgactctgtaatatttaaaattgcaaaaaatatatatgacaaagaatttaaagtatcagacaaggaaattacccagcatattttagctagcattcttgaagaatcaattatttttattttaagaatattttttattgcatatattgaagataacgaaatttttaagaaaatattagaagaaaataagctatacaggtcttctatatcttttagatattttttttatgatgaaaatacaaaaaataaattaggatataaaaaaataataacaatttttaatttacttgataaaggaagtgatgcaataaagtttcctatatttaatggaggattatttgcagaagacaaggttaaatatttaaataatgaaagtttactaagtattagtgagcttgaagaaatactggttaaaatacttttctttgaagaaaaaaatattaaagatgaaaaatttgtagagtattcaaagctagatcctaaaagttttggagaattgtacgagactctacttgaatatgacctaagaattgcagatactactgttcatcgtattgttgaagacggggtttatctcattcgtactgaagaagagcttgaaaataagcaagtaaacaaagttgctacatactataaaggcaatatttatcttacatctagatcgcttgatagaaagaaaagcggagcatattataccccggatgacttaactgactttatggtcatatcatcaattgaagaacagcttaaaactaagtcccctttagatataaaaatcattgataattcttgtggatcagggcattttttaatttcttgtttagattacttaacagaaaaagtatggtacgagctagataaatttgaagatgtaaaaaaagagcttgataaagaatatagagctattcttaaagaaagtgaagaatacgacgttcaagatagtataagtaaagaattggtacttaaaaggatgctattaaagaagtgtatttatggtgttgatattaatcctatttcggttgaaattactatgctaagcttatggattaatacctttatttttggaacaccactaagctttattgaacatcacataaaagtaggaaatgccctgctaggatataccaaggatgaattttttgatattacaaaaaagaaatttgaaagtggattttcgttatttaaagagagaattaaagaaattacaactattttagaagatagctatcaaaaaattaaaagtattaacgatactactaaagaagatatagaaaaatccaaaaagatatacaaagaatatgaggaaagtgaagatacagattatttaagaataatattttctttaatcaaactttattctttatcttttgacaaatctttaaaaatagaatttagtgatattacagctgtaattagtttaattgaaaatattttgggcaataaaacttctagcgaagataaagaaaaaatagaaaaaattagaaaagtaagtagctattataaattttttcactatggaattgagttcccagatattgaggaaggctttgatattgtaattggaaatcctccatgggagaaaaccaagtttaatgaatctgaatttttctcaaaacacattcctaattacagaaaactaagcataaaagaccaaaataaaataaagcaagaaatacttagtaaagacacacatcctttgaagattgaatacaatgaagaaaaaaatagtataagtactattaataatatttataaaagtgattttaaagattttactagtggtggtgatccgaatctttttagatactttattagatttaatttaaagctaataaaaccggggggcaatctaacttatctaaccccttcagctctttggagtgaatctagttctagattgctaagaaagcatatatttactaactataaacttaattatatttatcaatttcaaaatcaaaagagatttaaagatgtagtatcgctttttaaatttgtaatatttcaactaagtaataccaaattctccacatctatttttaaagcaaaatttatgatccagagtagtgataatattttgaaagccataactagagatttaaaagacaataaagacgatccttataaaggaattgaattaaatatagaccaaattaaaaaactatctcctattcaagaatcaattattgaattcaaagataatgaagaatttagcttaattaataagatgtttagtcaatttggtgtttttagtgaagaatatattgattttcaaaaaggggtagacccgagcattaataatcgtaaatctttattaaaagaatataatgatgaaaactttatatttctttattctggagccaatattcatcaatttaattcaagattttttatttgtgatgatgcaaaagaaagggctaaattactatggatagataaagaagatttaaaaaaaatattaaccaaagataaccaatgtcaaaccgaaagagtattctatagagatattgcaagaaatacagatgtaagaaccatgattagtactttgtcgcctaaaaattgttattgtgtaaattcaatgtatataaattatgaaaaaacaccaatatctatttataaaaaattatttattatatctatttttaattcacttgcatttgactttttgataagaagatttgttaatatacatgttcaaaaatcatatttatatcaatgtccaatgcctcagcccgaagaaaaagaaattttaagtaattctttatatctaaatcttgcaaaaaatacttctctactggtagctaaaaatgatccggggaactttaaatatttactttacttagaacattttaagtttagtaaagaagaagttgataaaatcttaaatctagataccaaagatgaattttttaaagaaaaagaaaatgaaaacaattttattgtagccagtctttattcactaaccaaagaagattttatggttttgcttaatgactttgaggtactaaaaaataaaaaaggagaagactatattttgtctttaataaaaggatatgagaattatttaagaataaataaacttaactcaacaattcaatct

SEQ ID NO: 101 - DNA, 774 bp, Borrelia afzelii
ttgaaaaaaaataaattaaatatcgttaagcttaacattattacagcaatattaacatcaatttgtatatcatgtgcacctcttgacaacgttaatccaaacaagctaaaaagccataccaatcctagaaagctaaaaaaaacaaaaagccataccaattcaaaaaatctagcagaaaataatcaaaatcttaaaaatgaatctcaaaatccaaaatattcaaatcaaaactctcaagaaaaaatcttactctcaaaattagaaaaaattgataaagatctgaaagatcaaaaaaaacaagaagatatacaaatagctaatattgatgcacaagatgattttctagaaacttttaaacttcaacaagatgaggtttttatgcacattacaaaaatgatattaaaaagaataatttactcatccttaaattacgaaaaagaaaaaatattgctattaaaagaaattcttgaaaaacttgataacaatgcgcaaaaccgaaaaatagctcgtacgtttcttgaaacatctagagatattcagcttctaatagaaaaaatacattcaatcaacatagaagatataagcaaaaaagaagccgaaaagctactagaaaatagggaacgtagtttaaaggcaaaacaaaattttgcaaaaacattaagcgcaaccattgacgcttatagtaaagatttcaacaaccttaaaaccaatctaaaaaatctagcaactcacataaaagataaatactaccatatttctctttatctaaccgaa

SEQ ID NO: 102 - DNA, 1056 bp, Borrelia afzelii
atgaaaattaaaagtaaatgcttagctttgggattgctttttggttttatcagttgtgatttattcataagagatgaaataaaagagaaatctcttggcttgtgtgatgaggaaagttctattttagagactggtgacaaatctgttaaaaagtctcttaataagaaaggcaaagataaggttgctagaaagaaagttgaaggtaatgctgttaaaaaagacccgtttaatcatcatgtaaagagggagtctgttaataatagtaatctatcacaaaaaaatgtgatatcggaagaagaaattttgaaaactaaattattaagagaacgacctgagactagaaaagaagaaatacaaaaacagcaagatgagcataaaaggatgcttcaaggaagtttaagttttcttagtggtgaaagtggtgaattgaaggatactattgaaagcaatgaaattgattttactatagattctgatttaagactgaagagtgatttacaagctatttcaggctcaaattctatttcatatactgatgaaatagaagaagaagattatgatcagtattctttagaagaagattattattatgatgaggaaacaagattaagtaatagatatgaatcttatctagagggtgttaaatataatgtaagttcagcaattaaaacaattgttaagatatatgataattataccttactttcaacaaagcaaacccaaatgtattctacacgtcttgacaaccttgctaaagccaaagctagagaagaagttaaaaagtttacaaaagaagaacttgaaaaagatcttaagaccttattgaactatattcgagtgagtgcaaggactgcgacaaattttgtatatgcaagagaaatatattcaaaaagaaaattagatgccattgaaacagaaataaaaaatttaattttaaagatcaaaggacaatctgatttatacgaggcatataaagcaatagtaaggtcaatcttattaatgaaagattctcttaaaataatcgaaatagtcattgataagaatggtgtttggtac

SEQ ID NO: 103 - DNA, 957 bp, Borrelia afzelii
atggaattatttgatgaaaattattatgcaaaagctgtagctaatatcataggagaagttaaagatcctattatgtataaatggtttttacccgatcaaatagaagatgttgatttgcaaatgggttatcaaagaactgtaaaatgggacgcttttctaaatgctaaccccacaacgattgccaatgaggttaatactatctcaactattggatttagttctgaagtagttagacttaattacttaaaactacagtacaaatttaggcacttaaaacaggcgtctgaaaaattttacacttcagactcatatattggggacattaataataatctacttccttttgctcaagcttataaacttgcaagtagcgaaattattaaacttattaatcactttgtactaaccggtgctgtttcaatccaaaaggatggaaaaaatcaaaaacgcttactacctaatatgtatggactacttaatatgccacatcaaataaaagaagaagttgcaagtggtgataaggataagatggataaaatatttgaaaaaattgaagctggactttcgaaattagagctgggggacgaattttctacacctatgatggtaatagttgaccctgcaacttcattaaaattggtaaaaccatattcagcagcacaaggtgcagcaatgagttgcgaaaaatgggaagatattttaattcaaactattaaggccattaataatagggaagatgtttacattgaaacttcaaacttgctaaaacatcaaatacttgtgtacccattaaacccagcgcttatcaagtttaaacctagcaagtatatgttacctacaccgaatgagcaagttgataaagactcaactgatattgctcattcatacattgattttgttttagggggtttacttgctactaagaatactattttgcaagtgaatattaaacaaagt

SEQ ID NO: 104 - DNA, 432 bp, Borrelia afzelii
atgaaaccagcactaccaaatattgcaagtataactgaagaacaaatatacaatgaatttataagattgggcatggaacaactaatagcacaagatttatctaaaagatattatcataatgaacttacatatagagatttagaaaatttagaaaaacaatttggcttaaagtttgataatcttatttataagatagacactgtagagaagactttacaaaaagacatatctaatttaaatgataagatagattttgtagaaaaaaatttaaaacaaaatcttgacgaaaaactcaaaattcatgaaaaatttttattagaaaaacttaatataagcaacagattaataattattattacaataataatagctccaatcgctatatctagcatagcaaatattattacgtcgataattactgggttttctaaa

SEQ ID NO: 105 - DNA, 555 bp, Borrelia afzelii
atgagtgacattacaaaaattaaagaagagtttgataaaaaagttgcagaaattaaagcattaatgaaaaatccgcaacaagactctggtttgcttagtaattctttagagtttagagataaaaacctaatttattctaattctggtggtgtttggactagcagcaaagacaaaatagaaaactattctgttaaagggtacccctataagcgtggagtcaagcttagttttagtattgatggtacatcagagcttgaagttgaggctggtggtggtgatgatttatatggcatatgcactgatatagatgagtttagtggtatggcaactgtaatgccgattacaaataactttacggggtatttaacatttaagaaacctggaaatgatataaaaccgggtgacaagcttcattttaatcaacatggggagcttgaaaagactactggaactgaaaaatctattaatgctatagcgctttcaaaagtacataaattaacagaagaattatttatagggcttgctagtgtttttgggaatagagctttaaaaggg

SEQ ID NO: 106 - DNA, 1059 bp, Borrelia afzelii
atgggcgacaaattcactattaaatttaagggcgttcttgatcatgcagtaacaaaaaaggctatcgaacaagatattaccaaaatggaaaaatatcttaaacctaaaaaatctagtttgggcagtactaaagatattgtaaaaaataatttgtcggataagaaaaaagaattaagcaaacaatctaagtttgaaaacttacgagaacgtgttgagaaatacagacttacacaaactaaaaagcttatgaaacagggtatgggttttgagaaagctagaaaagaggcttttaaaagatctttaatgtctgatagagataaaagacgccttgagtataaagaacttgcaaaagaatcaaaagcaagaaataaaatgatagcggcttctcaaggaaaaggacttgttgccaaaattgcaataggtagcgccctgggaaatgttattggtaacgctatgagtaaagttggaggcggacttttaggatttgctaaaaaagcagttgaggaaaaatctaaaacgaatagaactaaacttctcaatagtgcgttttttgagaaagatgaacggaatgcgattgtggggattaaaggcaagggggggattcttagcggtatgaaaggattcgagcgcgacttagaaaaagaagagtttttaaatcaagcaagtgtctttaagggtactttaagggatttaggtatgctaaatctaaataatttaaaaaaagcagtagagttttcagctgcgcttaaatctagtggcgctatgagcggcgaggatgctgtaaaagctgttaatagtctgcttagtggagagggagatgagctttttgatctactaaaaaagtcgggggttggagacaaatatatagaagatgctaaaaaagcttggcaaagtggcgccgaagtagatctagaatctagaattactatgttggttgaaatgtttaaagattttaaatcttttggccttacgaaaaaagcagatacgaaagaagagattgatagcaatttggcctcagctgagcaaactctttcaaacttaaccaccactgttttggat

SEQ ID NO: 107 - DNA, 1110 bp, Borrelia afzelii
atgaataaaaaaatgagaatgtttattatttgtattttttttacactgataatttcttgcaagaattatgcaagtagtgaagatttaaaaaatctagaacaaaatgtaaaaggaaaagttaagggatttttagatacaaaagaaagaattgtttcagatgatccaacagtatatgaaatagcagaaaaattaaaagaagaagaattaaagggtaaaaaagaaagtaaacaagaacaagaagataaagaagaattaatgcagggtgatgatcctgctaacatagatttgccttcaatattgcagacaaataatcaagatagcacaccagcattagaagcagcacaacaaattacaagtggtggtcaacaaaaagaagaagaaaaaggcaaagaagaaaaagaacaagcaaaagcagaagaagtaaaagtaaaagaagaacaaaaaggagaacaagcaaaagctaaagcggaacaagaaaaaaaagagaaagaagaaagagaaagaaaagagaaagaaaaacaacaacaagaacaacaaaagaaaagacaagaagaagaaaaaaagaaacaagaagaacaggaaaaagctaaagcagaaaaagagagaagagagaaagaagaaagacaaagacaagaacaagaagaaagacaaattaaaagcaaaatcgaaacactcacaaaaaaaatagacgagataaatagagatattgactctattaagtataaaagttggtttgtggagaatgaaaaaagactagaagtaaaggcgacagaagttagagataaagttacaggccctatatatgaccattttaccaatgatgctaatacagccatatactatacttggaatttagaggatgaagaagatttggaattaggaaaattattggaaaaattgagtaacactagaaacagtttaagaactaaattaaatgaaaacaatgcaacgtatactttggaagagccaaaattaaaagaaaatgtaaagattgaagaaattgaatcagacttagatgaactaaaatcagaattagaaaaagttaaagaatatcttaaaaacgaatctaattttaaagaaattaaagagtatatctctagcagtgatgat

SEQ ID NO: 108 - DNA, 555 bp, Borrelia afzelii
atgaacaatttagcgtacagaacatataatatagaaagcataaaaaatgagtttttaaacatagggtttagcgaggaggcaatagattttgtttttcttcataatgataattacagctttgaatatttaaaagagaaaataattgatatagagaagactttacgaaaagatatatccaatttagatactaagatagatactgtagaaaagaatttagatactaagatagatactgtagaaaagaatttacaaaaggatatatccaatttagataccaagatagattttgtagaaaaaaatttacaaaaagatttatttattttaaatactaagatagataatgtaaaaggtgaaattactaataagattgaaaatgaagtaaagaatttacaaaaagatatatctaatctagatactaagatagataatgaagtaaagaatttgagaaaagatcttaatatgggaaacaggctaatacattttatgatattaacagccgcaattctaggcccaatattaaatgctttatttatgaaatatttacaattcattaaa

SEQ ID NO: 109 - DNA, 708 bp, Borrelia afzelii
atgaataaaaaaatgaaaatgtttattatttgtgctgtttttgcattgttaagttcttgcaagaattatgcaattagtaaagatttagaaagtttagagcaatcagaacaagagttaaaaagtccaaaacaaatagaacaagagataaaaaaagaatttaatggattgttaaatattttagagaaaaaagacatatctaatttagatgaaaaagatacgaaagaaattgaaaaaacaattaaggacttaaaggatcaaatagaaaaaacggatgctaaaaaaacttctcttaaaacatattctgagtatgaaaaaacagtaaaagaaataagagaaaaattaaaggataagttaaaagataagaaagaacttgaagataaattaaaagaacttgaagatagcttaaaaaagaaaaaagaggaaaggaaaaaagctttaggggaggctaagaagaaatttgaagggtataaagggcaagttggttctactagtggagtaactcaaggccaacaaactggaaatcaagggaaagttggacaacaagcttttaaggatgttaaagaattgggtttaagtgtaagttcttctagtaagaatggtgctgatactggtgatatgtctaaaggaataatagatgatgcacttaaacagattaatgaagaacttaaaaataatggagaagaggctgtggaagaaaaaaaaataaaa

SEQ ID NO: 110 - DNA, 462 bp, Borrelia afzelii
atgaaaattatcaatgtattattttgtttatttttactaatcctaaacagctgcaatgctaatgataatgacactcttaagaacaagaataaacttactgagtcccaacaagcggaaaatggggaaaaacataattcaggccaaatagaactacaacaagaaatacctaaatctcctgaagaattacttaaagaaaaactatctgaagatcagaaaatacatcttgattggttaaaaaccgctctaactaatgctggggaatttgataaatttttacaatatgatgtatctaaaatcaaaacagcacttgaccatataaaaactgaacttaataaatgtaaggggaaacaaaatgctgctcaacaggaaaacacttttaaacagacggttcaaggggcacttagcggtggggatatagataaattcccagaacaagcaaatagtttgtgcgacattcttccg

SEQ ID NO: 111 - DNA, 567 bp, Borrelia afzelii
atgaaaactttggttggcgcttgtatagtaacattggctgtattgggttgttatttgcctgataaacagaaacaagccgttcaaactttttttaagaattcacaaagtagtgatataggttctgatgagattgttgctgatgaaattgttgctgatgggatatttgataatttaaaattatatatgactgagcataatttgctagttgatataaaaaagaccataatcagtttaaaagatcctaattatcgtgctgtacccccagtgcgtgactataatgaggagtattttaataaattctttttagatttggggtctgagcgatctaaagaattgattaagttatttggcaagataaaaaatgagcagaatgatgataaatttaaaagagaagcttattggctatattcatgtataagggatttatattcttcagatattaagtattctggtgaaaacgggaatgagtatattgttgatatgcctaggaggcccactattgatcaacaatatcttaaagtgaaggggagtaatagaacagtatgctttaagatgattattgtctac

SEQ ID NO: 112 - DNA, 333 bp, Borrelia afzelii
atgcaaaataatactattggtttagggcttaatttactatcaagcttaactaacatagctaaaactgatacaaacatagatcataattacattaatacttttagcaaggtaatagattttttctacaaaacatatatgaacacactaaaatctatggaaacagccgaatcaacaaaaatattagaagaaatacaagacatattaaaatacaatattgagataatagaggctatttctaataataaaagtaataaaattatctcctcattaaaagcaaaacgcaataaaatcatgcgggaatatattaatatccttaaaaggggtgaaaatgct

SEQ ID NO: 113 - DNA, 528 bp, Borrelia afzelii
atggaattagtatcaacaaaaaatattactgaagaacaaatatataaagagttccttagactaggaatggagcaactaatagcacaagatttatctaaaagatattaccacaataagcttacgtatagagatttagaaaatttagaaaaacaatttggtttaaagtttgagaatcttgagttcaagattgatactatagaaaagaatttaaatactaagattgatactgtaaaaagtgaacttaataccaagattgatactgtagaaaagaatttacaaaaagatatagctaatttagacgctaaaattgataatgtagaaaaaaatttgaaacaaaatcttgacgaaaaactaaaaattaataatcaatttttactggaaaaaatagaaattaataatcaattattgtctaaaaatcttgactcaagcaacagattaataactattatgtcaatagtattagtacctattgctatagctattatagggccttttgttttgtcgctaattaatggttttttcaaacag

SEQ ID NO: 114 - DNA, 471 bp, Borrelia afzelii
atgagtaatttagcctacaatactcttaaaatagaaaatataaggttagaatttttaaataaagggtttagtgaagagacaatagattttattttacttcagaacgataattacaactttgaagttttaaaagaaagaatgaattctttagaacaacaaataattaatgtagaaaacaactttcaaaaagatatatatagtttagatgtgaaaatagacagtgtaaaaaacgaacttaatgcgaaaatagacagtgtaaatgctaagatagacaacgtaaaaaacgaacttaatgcaaaaatagatagtgtaaataccaagatagatggtgtagaaaagactttacaaaaggatatatctagtttaaaaaacgaacttaatgcaagtaatagaacaatacaagtaatgttaatagcgggaataacacttgctccaattatttactctatatttaataagtattttttcaat

SEQ ID NO: 115 - DNA, 558 bp, Borrelia afzelii
ttgatgagtattaaaaataaaatgataataaccaaaagagtagagataaaggaaaatatttcaaaaatggagtcattagaagagattcataaagaggaatatttgagattaaaagataaattaaaaactctaacaacagatgacatttataataaaatagaaacagcaaaaatattgaatacaattaatcaaaaaaaattgtatatcttggatggatataaaaatttttatagttttttagctggttttaaaatagctaaatctcaagcatataagtatataaaaatagtatcgggtgtagaaaaaggtattattgactataattttattgctagtaatggtattgaaaaaacaattaagcaattagaaagtagtaatattattaagaaatctaatcaaaacccgataaaaccattaagatttcagcttaaaagacaagatagttacgatttttataaaagcaatgctaaattcacaggatttttattagataaattatttagtgatgaaaaagaaatgattaaaaaaattatgaaagaatataaagcattaaaggga

SEQ ID NO: 116 - DNA, 540 bp, Borrelia afzelii
ttggatattaaggtaaataaaagagatttaagcgataatgggaattatattgttgctgatagtgcattaaatcattataattctttgaaagaaaaattaaaaattaattctaaaaaagaaatctattgtaagctagaaactttaaaaattttaaaagaaattaaagacaatgaatattataaacttgatgggtataaaagttttgaagctttttctaaagattatagacttgcaagagcacaggtctataattatttaaaaattgctaatgcaatagaagatgggattatacaagaagaatttctaataaaaaatggcatattggaaacgttaattatattaagaaataaagagagcaaaacaataaaaaagtccaaacaaaacccgataaaacccttaagatttcagcttaaaaaacaagaaagctatgatttttacaaaaatcatgccaaatttacggcttttattttggaagaacttcttgaaaatcaaaaagattttcttaataagcttttaaaaaaatataaacaattgaaagga

SEQ ID NO: 117 - DNA, 438 bp, Borrelia afzelii
atgaaaaacagatttttttttatatatttatcatcatcttttgtttttttgtttagctgtaatggttttttgacacttgaaagcaaagaaagatcaagctttacagataaacaaagaataagtattttagagaccatcaaaaaccactataatggcgactctgaaaaaatagctagagttgacaaatattttgatcgattagaggattctcaaaaagatgtttttttacaattgttttcggctggatttgactatataaactctaaagaatcagaacctaaagaatcagaacctaaagaatcagcaaatagaagagctaatttagatgctttaaaaagtaattttgaatccaaactaaaacagcttaattacacagaagaagattttaataaattggtagacgactttaatgagtttgttgatcctaagcccacttct

SEQ ID NO: 118 - DNA, 390 bp, Borrelia afzelii
atggaaattggagaaaaaataagaaaatcaatatttgataatgcaaaaacctttgtgggattcaaagttaaaaaaaacatggagcaattgaaatcaagtgtccctggaagattatcaaatgtaacaaagattgatttagaagaaacttctttgggaatagatctaaaggtaaaagtagactcccctcttgctgaatttctagattcgggaaaagcatatggaaataactcttcaagtccaagcttagcaaaaattaggaattgggcagcatataggggtatagaatccgctgtagtacctatttggctatctctgaagaagagaaaacctaaaacccaatatacaaactggacaagcgatttagtaaaggagtctgcaaaattacttaga

SEQ ID NO: 119 - DNA, 1074 bp, Borrelia afzelii
atggtcaaaaaagttgttatttcatcaacatctataatgttatctattttctcattaagttgtgatttgcgaaaagaaaatgctggaaacaaaataggtagtgttattagttcgggaaaagattattgggataatttaggttgtaaatatttaagtggatctgaaaaatctatattcaatgcatttcctaagtctaaaaaaagtcaagtgttttattctattttaaagaaagaaaacggaaaagatgctatacaattattaattaattggggtatagattttcaaacagcaagctctattgctattagcatagataaagaattagtagagcttaagaattctcaaattaaattatccgataacgattcttatgaggtagggaatgccgggaattataatttaccttacagcagtattgacagtgataataacttattaagtgctgatagttccttctattctaatttagacagcaatgataatgcaaatacgaattatttaaatagccagaactatacatatcaagaatataccaataaacaagcacaagaaatgcaagaaatatttaagaaatataaaatttttaaagaaaatgcttataagctttcacaaactttgaataagtctacttcttatgccgaggaattaaacacaaaattatctgaaatcaatacgaaagaaaataataaatttattttaaaagcagatgatataaaagatataataagattaatagcccgaataaaaatgactcaatatacagatttgtcaaaaaaaatacttgataataacttttcaaacatagctagtgatgaagagtcagctcgttatgttcttctatataagaatactaatagtccttatcttgaagttcgaaaaatacttggcagcattttaagcaagatatcaagcatagtagggggatctaaggctaatgtagtagatattgaggactctgaaaaaattaaaaaagctaaagagtatgctcaaggtgtgcttgacatattaaaatcaatagattctggagaggccgtagaagctgttttaaataaagcaaagcagctagaaaaaaaa

SEQ ID NO: 120 - DNA, 483 bp, Borrelia afzelii
atgaggattttggttggtgtttgcataataatattagctttattgggttgttatttgcctgataagcaagaacaagccgttcaagctttttttgatgagaattcaccacaaagtagtgatatgggttctaatgagattgttactgaaggcatatttgctaatttaaaattatatgtggctgaacatcgtttgttgattgatataaaagagactttaatcagtttaaaagatcctaattatcgcaatgtacctccagtgggtaaaggctataatgaggagaattttaataaattctttttagacttaggttctgagcgatctaaagaatttattaagttgtttggtaggataaaaaatgataggaatttatttgagaaaaaagtttccctgcttttttattgtatagaagataattcttcaaatgggatcgattttaggtctattaacgcaatatttgatgaagaggagaaaggagtaataaaa

SEQ ID NO: 121 - DNA, 621 bp, Borrelia afzelii
ttgtgctatattaaaaaatatctaatttttattctattattaaaccttataaattgcaatttatccaataaaaacaaaaattcagatcaggacgacgctattattagtagtcttgatagtaatcagaaacaagctttcatattttttaaggacttagttaaaaataaacagtattcaaaagattttgatcaagcagtcgaaggcgaagaagggcctttagaatctttgaaagcacagatagaagaattaaaaaagaaaaatgagcaatatattgagctgcaaaataagcttgatcaaggatttaactgcgactatgacgatagtaaaatgaaaaaattatttgatgaacttggaaatgacaacgtgaaaaaatttcttcaacaattacatctcgtgctaaaagctattaatgatggcacgcatataagctttacatcatcaaatcttacacaaactacaaaaactttaagtgaaaaacaagaaatagtattagacgttacaaaacgtaatttatatgttcaattttatttttacagtaataatctttatagggaaggatatacttcggcaggatatttcttcaacgaagtaatggaatatcatttagcaatggataattac

SEQ ID NO: 122 - DNA, 342 bp, Borrelia afzelii
atgttagagacaaaagttaatgaaaacgatgtatataatgagctcgttagattgggtatgaataaaatattagcaagtgatttggctactagattttatcataatgaaataacaataaaggatttagagattgttaaactagagcttcaaggttttgtaagagatgaagttggcactgtaaaagatgaaattaatattgtaaaaggaaaaattaaaagcttaaaaaccgaattcgatagtaaattaaaacttcataattggatgataggaattgtattagcctctcaaggaacaatagcaggtattttagttagtctattcttttatatagtgaataaatta

SEQ ID NO: 123 - DNA, 507 bp, Borrelia afzelii
atgaaaaaaattagtctgttaatatttttgtttttatttgtagtaagtttaagtgcaaatatagaagaaaattatacagaaactaaaagagctttttctaaagaagattttaacctaataaataaaagactagataattatgattttaaaaatgagtatgaaaaaagtcatgttttttccgatgctcctagaattagaggagatttaagaaaaattggaattaaagaaaaaagtgtttttttggacgctcttgaggctattgaatatcttataaaaattaagataagtactgatagtattttcctgtctgaggatatgattagacttatagggagttatccagattcgatttttaattatttgatacaattaaattcggataaaattgattatgctgagaaatatggagataacgccagaaataattttaaaaaagattattctgaagataaagcaaatacagttaaacaaattttaaaacaaattttggctgatttgcccaaagat

SEQ ID NO: 124 - DNA, 126 bp, Borrelia afzelii
gctattaaaagacccacaataccccaaagccatccccaaaaaaacaaaaaacataagagcaaaaatggtgaaatatcaagtcttttcccctgcattttcggttcaagaatatttccaatcaacatt

SEQ ID NO: 125 - DNA, 84 bp, Borrelia afzelii
agcagattctgctgttatttgagcagcatatggagtcgactttttagcccctttaaaacccatcccaccagcacttgcccaagc

SEQ ID NO: 126 - DNA, 138 bp, Borrelia afzelii
aatctcggtgttattgccatgacaaaagagaaattttcatttgcagttccatctgagcgctttattaccttaaaaaggttcatgtcaaacaaaagctcaaatccaacagaaacaaaatcatcaaacttagcaccaaat

SEQ ID NO: 127 - DNA, 435 bp, Borrelia afzelii
cttgaaataataggggtatctgatattaaagacatattgtctccaaatgcaccagcactaaaaatagcaccagcaaccaatggaagagaaatgtttaccttatctgcaagttccaaagcaataggagcaacagcaacaatagttcccataaagcttccagtagaaaaagacaaaaaaagagtaatcaaaaaaatgccacatactagcaaattcaatggaacatatttaagaccaatatttactacagcctcaacacttcctatttctttgcaaacagcagaaaaagcaccagataacataaatattaaagatataaaaataacatcttgttgcgcacacccctcaataaatttattcatttttgctaaaaaagatcccctaaaaaaaataaatgtcaaaacaatagcaataaacatagcaaatatggggggcatt

SEQ ID NO: 128 - DNA, 255 bp, Borrelia afzelii
ggatctaaaattttacccacattgctaacaagaccatattttcttgcaagatacccatcaataaaatcagtaaattcattaaaaatgattaaaaaccaaataattccaaaaaacaaatacgaaaaaaatatattttccaaaaaaaataaaattaatatgataaaggaaagtataatcctagctaatgttattttattaggagtaataattttgatcaaattattcaatttatcaaatctccttatctcttatttt

SEQ ID NO: 129 - DNA, 258 bp, Borrelia afzelii
aggaattgtgacctctttgccaaccaaagacttatatctctcatcattgggattaacagcaatagcagtatccccaaacattgtctcaggcctagttgttgcaatctcaataaaagaagaatcatcaataaaatacttaacaaaataaagcttgccatcaacctctttatattcaatctcttcatcactaacaacactcccagatccaggatcaagattaacaagatattcacccctataaatcaaccctttagaata

SEQ ID NO: 130 - DNA, 219 bp, Borrelia afzelii
ggacttttaatttttccttcaattgcatatcctagcattttgagtttattctcttcaaagttatttggaacttcaaatgcattcaaagatatgtttgaaagattgggttcttttacttgccaagattgtttggagcttgcaaatagaggcaaaaattttacttccgtttcatctttttttacaagttctaatgagctgctccaaggaattgtagcagca

SEQ ID NO: 131 - DNA, 267 bp, Borrelia afzelii
gattttaacaaagactcaaactcttctttaaaaatattaattccttcaaggcttaaaaattctggggtcagtggagtaataacttcacacattgcaagaataattcttcgctcccaaagctcaaaactgggagataaatcaaaaattgcaaattcaaatcccaatttctccaattccaaacaaaaatcatctatcaaatatggaaaatcttgcaattcatgttgcacatctcttctaaaagttccactcggcacacatggcaaaata

SEQ ID NO: 132 - DNA, 153 bp, Borrelia afzelii
ttttttattttatcagcatgtttttttgttgctgcttcagcatcattgtcgaaattacagctatttaaaagcgaaaaaacacacatacataaaattattttgtttttcataaatattctccttaattggcttagattaagcctattattatat

SEQ ID NO: 133 - DNA, 189 bp, Borrelia afzelii
atatctttttcaatgattttaagacgatcttctttgtccatattaataatattgcgattaggaaacacagattctattgcctcttgcaccgttttccccttgaagtttttgttctctaattttcgatcaaagaagttgctactaattgctaaccgaacgtcaagctcaacactaaaatcaccaccagga

SEQ ID NO: 134 - DNA, 108 bp, Borrelia afzelii
atattagccccacaatatagaaatatacagttttcatcattgcattcttttagtaaaaatttgagattattcatatctgctgtgttcaaaccccctatgaagttcata

SEQ ID NO: 135 - protein, 656 aa, Borrelia afzelii
MKFNRFLMLFLFNFGVLLGSDTTALGHYQKAHEYYLSKRYYDAIDELVEAIKINPNYYEAYKFIASIYYSLKIYTQAQFFIEKAYKMSNEDTEYKILYANILLKNDKIDQAKKIYSEVLVKQRNNIDALVGLASIFEKNGLFIAAANYYLSILDYSQNNYSAFEHLIDIYQRLEMHDKIRHLINKVRINFLSFPDFHKRVAEFYISINNLGLAEKYALNYLALIESSYKDFGVVDAYRLLALVYLHEFKYEDAIEALQKAILVDKESDELYYLLGYSYLKFGNVEKAILNLERAKNLKKDIEFYNIALEESFFASNFRNFLKNDSNTKISKHYENEGSKAFKSLNLNKALFNTKNAVDIWPDNDSARFLLSKIYKLMNLDIMAYEQLFYLVKQRNSTDSRILDFYDVVSFDVRKSLFYKYGYKSIADFNKLYDDRMVYRMAIFTQSENKFFGANDLILRYAERVLERNLNIEIVNYNFDYNKNKDYLINNFSEGFSYSRNNNLDLFLIFDFKADILKNTATLVVNVFSGKTGIKVGSFSYDVGGVNYLSNALNSLSKDFYDYLPKKGKILQIKNDDTLINLGQVNGVVKGDIFLILKEGALNSGNRDSSFIVYNKTDILGEILIEDVSDYISRGAIKSSTFLKDYIQEGATVIVKR

SEQ ID NO: 136 - protein, 238 aa, Borrelia afzelii
MNLMLITFNEFKTGISLNDTRAEHLVKILKLKDNDKFKFGILGEKNIYHCIYKKDKKLFFKKIFKIGESNKLKKINVLIGMIRPIVAKRIIKELASIGIYEIIFFNTELTEKSYLNSKIFKNNDYEKHLIAGAMQGGVTYFPKIKIMGNLKDSLKYIKQKNFEIKILLEKNSKKNLIDIEQTNNATIIVGPERGFTEKEKQLITQYNFSSYSISPNILRTETAIIAASIITASKLINI

SEQ ID NO: 137 - protein, 315 aa, Borrelia afzelii
MKIFFVSSSSIALEVFKEIVKHYEVVGVLTLPDNPKGRGQKLSQNVIKLEAIAKNIKVFDPLILDDNILNLIRDLNPDLMLVFSYGKIFKKEFLDIFPKGCINVHPSLLPKYRGVSPIQSAILNGDCVSGITIQNMALKMDSGNILVQKNFKIKSCDTSYDISKLVSSLSPNLVLEALEKIGKGFLGIPQKSSEATFCSFFKKESGFVDFNLSAFEIKNRINACNPWPLARARLDYGDIIFHRADFLKIDLYKEKKVGEIVDFDSEKGLFVNTGEGILLLLEVQRPGRRVLDYKSFYNGSRQLIGQVFSSIGGVY

SEQ ID NO: 138 - protein, 269 aa, Borrelia afzelii
LEIEFNILEKQYKDLLTISYFKEELDANDAFLTIHSGAGGTEACDWVAMLYRMYSRYAERKKYKTELIDLLEAEGGIKSVTIEIKGEYAYGLLKSEVGIHRLIRISPFDAAKKRHTSFASVFIDPVIDEKIEIIIKPEDIRIDTYRASGAGGQHVNKTSSAVRITHIETGIVTQSQSDRSQHKNKDMAMKVLKSRLYEYYKNKEDEKNKSKQDTKKEISWGNQIRSYVFQPYNLVKDHRTKFENSNITSVMDGNIDNFIEEYLKWKSLN

SEQ ID NO: 139 - protein, 342 aa, Borrelia afzelii
MKKNQLILLLFIPQIIYAKSYFASDVFFNKYQKLNEKPKTGFYIEYYFIDDIEKLYLYKENNLIKYKTIQIIENTRKITYYDTKDTKRKEEIYDNLNNKIQEIEYGNKGKILETVNYYYENGNLISKNLKTKNQKPKSIYYSKDENGKLLKITGSDFQIWNYGINGDIKSTYFDIKKSTTKVIKYDDKKRSLDSAIIVNNKIKSKEKNQYLDEQKTVNIFEEENSKIISTYQGNNLIKEEIYKNNELIKINDFQYNSSDMMILQSTKEKDKDQYTNTKIEYEYNQDNQLKSKKIYENDTIYLKTEYHNDNEYEEEIYYNKTPALRVKHKNGKVTEEKPIGTN

SEQ ID NO: 140 - protein, 417 aa, Borrelia afzelii
MMLLKLTEITKIAYIIFKNSTNKIALIGSGISLSLVMIPLIIVYYMSSNIMTSTINKYIESEGFSTQIEYNDTNKTHQLKDRLDSFKKKYNYKDLNYFFEKRTYGIIGNNKKQGVLIRAIENKFILENKSIKLLQGAKNLKKDSILISNQIKNKLNLNLNEKIDILIPNTKNNKIMPRIKKFNISGIIETGLKDIDNNLVLISFENENLMSKKFSKSIIGVETSSNYIKNNEILKQNLETEFKEFQIKTFYELYLNKYNNLDISKKLLIFIMALIIIFASINISSSLSMLIFENKKKIAILKSIGMNNLNIKIIFLLISLTLSTTFCGIGIIIGNYLTLKISYLINFVDNVLNFFLKIFGEEYSEILNSEYYVSEFQIHLSLSFSLTLLGLYMLISILTTMIPLNIISNLKEKKILR

SEQ ID NO: 141 - protein, 144 aa, Borrelia afzelii
MDIGLIGVNSALTISAIGSALGMGAAGSAAIGAWKRCYMQGKPAPFLLIVFVSAPLTQIIYGYILMNTLYEVMMQTNPWLLLGAGLGGGFAIAVSGFAQGKAAAGACDAFSETGKGFATYLLVLGLIESVALFVMVFLMIFKFV

SEQ ID NO: 142 - protein, 575 aa, Borrelia afzelii
MNTKGKVVGVNGNLVTIEVEGSVSMNEVLFVKTGGRNLKAEVIRVRGNEVDAQVFELTKGISVGDLVEFTDKLLTVELGPGLLTQVYDGLQNPLPELAIKCGFFLERGVYLRPLNKDKKWNFKKTSKVGDSVIAGDFLGFVIEGTVHHQIMIPFYKRDSYKIVEIVNDGDYSIDEQIAVIEDDSGMRHSITMSFHWPVKIPITNYKQRLIPSEPMLTQTRIIDTFFPVAKGGTFCIPGPFGAGKTVLQQVTSRNADVDIVIIAACGERAGEVVETLKEFPELIDPKTGKSLMDRTCIICNTSSMPVAAREASVYTAITIGEYYRQMGLDILLLADSTSRWAQAMREMSGRLEEIPGEEAFPAYLESVIASFYERAGIVVLNNGDIGSVTVGGSVSPAGGNFEEPVTQATLKVVGAFHGLTRERSDARKFPAISPLESWSKYKGVIDSKKTEYVRSFLVKGNEINQMMKVVGEEGISNEDFLIYLKSELLDSCYLQQNSFDSIDAAVNSERQNYMFDIVYNILKTNFEFSDKLQARDFINELRQNLLDMNLSSFKDSKFNKLEHTLSELVNFKKVI

SEQ ID NO: 143 - protein, 398 aa, Borrelia afzelii
VMKKVAIIDGLRTPNTKFGGSFRGLDIIDESSKVVKALLGRNKLCEVDEVIIGNVISAGLGQNIARQIALKSNLGDTVPAFSVNKVCGSGLKALELAFNSIVLGNNDIVLAGGVEDLTNSPYLLPRKIRFDGLKFGNFELEDSIQKDALIDSLNFISMGLTAENLSEKYKITREMQDEFAYNSHVKALKARELGYFEDEIYPLTVFDKKTNSSRVVSSDEEIRDNVTLNKLASLNPVFKELGTVTAGNSSSLNDGACFLILASEEKAKSLGISPLAYIGGFKSVGLDPLYMGFGAYAAIEGIISKLSLNPSEIDLIEVNEAFAAQALSIEKALFKKYNITSDIININGGAIALGHPFAVSGSRILLTLSRSMKMKNKAKGIASVCVGGGQGISSFLYR

SEQ ID NO: 144 - protein, 553 aa, Borrelia afzelii
VRMENQKDLQENYLKVLERVELGSRVSGTIVNIMKDYVLVDVGYKSEGFIKIEEFENVPKIGDKLEAIVVRIGGELGLILSVEKLDSLNFQDKVNEYIQNKKVIKGKVLVELSNGYKIQINENVSGFMPFYLSSKSKDEKLKRGSIVEFYILEASETDGLRLILDRRTLERERELAKRIELVSSYNEEDVVDGMVDRITEYGAIIKIKNFVTGILHKRNIAFNQVENIEDFIRVGDKLKLKIIKINPQTGKMELSLKALKANPWDSVDVKYKIDSIVKGKVVKILPFGAVIELDSELSGFLHISNFSWIKVVKSPQELIKLGQMVEVKILEIDKENQKISLGIKQINENPWERLTEKYPIGKVIQGVVTNITKTGAFVNIEEGIDAYVSKFDISWLEEIDPEEYFKIGDLVNGKVLEVDRRKRNVRLGIKQLEESPWEDFSKSYKKGDAIEVEIVEKKSKGFQVRVYNKIMGFISKIQLGDTKESSLETFEKLSIGDKLKVVITNIDSKDKSVLLSYREYENQKSREEISSYLFKGNDEESYKPFENLLKRDE

SEQ ID NO: 145 - protein, 628 aa, Borrelia afzelii
MTKRLNNKYRTKTILTIFLGITLLTVYKYFTLMVFNNSPDNIISLKSNDIVKRGTIYDRNGKPIAFSSKSYSIGTNPQKIENIVSTSETLGAILQIDSRILKEKLSSNKGFLYIKRKIKREESDLIKRIQAEGRLSNITLYPDYTRIYPFRYTTSNITGFVGIDNLGLEGIEFSLNSILGTDKTRQQFLNEELETNNIYLTIDMNIQQGVSKIAEKYFKENNPESLITLVMNSQNGEILSMVQFPQYDANFYSEYPEEIRKNLSSSLTYEPGSINKIFTVAILLESGKLNLKEKFLDNGIYQKQFPSGEKITIKTLNPPYKYIDSTEILIYSSNVGIAYITEKVSNEYFYKKLLDFGFGEKVGFPFPGETKGLLNHYSKWSGRSKATIGFGQEIGVSAVQILQAASILGNNGIMLKPRIIKKISTDKGESIQEFDKEEIKRVISKNSAQKVLKMMREVVNKGGIPNLKIKNLDISAKSGTSQAIDRKTGKYSEEDYTASILAIYPTEQPKYIIYIVYRYPKKIIYGTRIAAPMAKEIIEFIEYQQNTNAYKKIKMPSKIKIPKTDTNYKNKEYLPNFINLSKRESIDILKYYENTIKIKINGDGFVYKQSISPNTKLEDIAELELYLK

SEQ ID NO: 146 - protein, 336 aa, Borrelia afzelii
MIINHNTSAINASRNNAINAANLSKTQEKLSSGYRINRASDDAAGMGVSGKINAQIRGLSQASRNTSKAINFIQTTEGNLNEVEKVLVRMKELAVQSGNGTYSDSDRGSIQIEIEQLTDEINRIADQAQYNQMHMLSNKSASQNVKTAEELGMQPAKINTPASLSGSQASWTLRVHVGANQDEAIAVNIYSANVANLFAGEGAQAAQAAPVQEGAQEEGAQQPTPATAPTQGGVNSPVNVTTTVDANTSLAKIENAIRMISDQRANLGAFQNRLESIKNSTEYAIENLKASYAQIKDATMTDEVVAATTNSILTQSAMAMIAQANQVPQYVLSLLR

SEQ ID NO: 147 - protein, 665 aa, Borrelia afzelii
MASGFFVPGLESKYNTKEIRESMLKPDKAKIDSSFKKLESLEQEKSAWQLINRKISTLNSLAKELTSLNSPFNLMSGNSSNSEVLTLSTRYGSKNETHKLIVDQIASADVFLSSNFDPKKVTIPEGEYVFLVGKKEINVKSNGNIDLLVRDINNKGKGFLSAKIVKSDKNGNSRFILQSLKEGKENKLIIKGEGLAFAKQIGILSELKTNFNPNLSDIVVNQSSSNNRLAFENNNLVLNPLSEVSIEIPEDIEITSRSKIKFEVKYFDTGLEESDSKIIFNPGEATFKDAKVDSEDSVVDLGSDLKTPLEKKYIQMNMVKISSKEGSLELPLINISNNFEEVEVDIGALSNLEEINIENKANNKVVVISNVEVFDPKNRDGYLPINAKSFAENAKIKFDGVDVERDSNVINDLVPNVTLSLKKASSDMVEAKVEPDYEGIKRILLDFIGAYNEVLAEINIVSSNEDQLGNQKSSIVEELTYLSESQKEEAYKNLGILRSEFLLKNLKSRLESIIFKPYVTSDPNFSIINQIGVFTNSISSSGGLSRYLRLDEKKFDESIRNNIDNVRELFLFDLNGDRVYDNGIAKMLGDCLSPFVTSGGVIYNKIKNYDLKIIDQKNKVEDYKKKYDDRERKIEGELNTLDFTVKRMKDQENTLKAFDFNQRNR

SEQ ID NO: 148 - protein, 401 aa, Borrelia afzelii
MLNFCLFNSKSVLTGNDKLDNSAVLIKDNKIFDIVTSDRLKKMDLREYQMIDTKGNYITPGLYDSHIHGFHGYGTDQCSTESILKMSEHLAQYGVVGFLPTLYPRPIDEMIQIIKACTAAIGKEKGAKILGLHLEGPFFSPEKRGAHPVSYLHEPSIKVMQKLIDAAGGIFTGSNGKRKTHIKTMTVAPELKGMRELAIFCLENNINLQAGHTNAKYENMIEGFQVGILHTTHFFNAMSKLDHRNPNAIGAVLIHGDVSCEIIADGHHIHPKLVLMLRKLKDISKIVLVTDGLTPNFQTSGKLIANGDEVYIAEDGLFHSVKSNTIAGSTLTMIQGLKNLIEFGYSLSDAVQASSYNPTRILNIDKKGLICHGYDANINVLDKDFNLKLTMIESKIIFNNL

SEQ ID NO: 149 - protein, 627 aa, Borrelia afzelii
VDSTFSGIEIGKRSLFAHKDAMNTVGHNLSNATKPGYSRQRVTMKTAIPLYAPQLNRAKKQGQLGQGIVVQSIDRVKDELLNTRIIEESHRLGYWTSQDKFTSMLEDVYNEPEDQSIRKRLNDFWESWHDLANQPQGLAERKIILERGKSFCEGIRSRFHSLERIYIMANDEIKITTDEANNYIRNIANLNKQISKSQAMKDNPNDLMDARDLMVEKLGNLISVSIENKQNPNEFLIHSEGRHLVQGSIANEFKLEATNGPTRTRWNILWANNDKVHLKTGKLGALLNIRDEEIKNEINELNNLAANIIELVNEIHETGHGMDKKSGRSFFYQELKLTDDRGRYDTNGNGQFDSVHIFKINSTNEIFPEEKLGFYGTLKFETTNSNEIVEIPYNAPDTVQDVINRINNSDAQVTARINSEGKLEIKAVKEQENENITFRIKHIEDSGLFLTKYTGILNESGPEGAYDYKNIDTTDKLTPKSTYSISPLKNPAAWIKVADTIDSDPSKIASGIKNLTNEISIGDNQAALRISSFGNSQIMIGKNLTLNDYFANTASNIAIKGQISEITKESQSQILKDLTDLRMSISGVNKDEELANMIEFQQAFIAASKFITVSAELIDTVINKMGV

SEQ ID NO: 150 - protein, 251 aa, Borrelia afzelii
MLENKMTGPKTLVVIAILAILTQGCKKYSIIEKQFDYAIIFSDATEYFFEIQKTPFIKNKILFINDKNLEITKDKLKTTKKILLTHKSTNEILNNEILKEKIFHLSKIKFSLKKSIDLLLNGKSIDLQKTLLFRDKSLNNEDLEYLEKKSQEKNINITLINEANISYIKTFITPQIQTIILFSLRDNNIILKKISNSPFFKNIKFVLIGNTRKDLKIIKLKYLITLKESDLMKIVKEVEKNFQYEFNIYKQ

SEQ ID NO: 151 - protein, 361 aa, Borrelia afzelii
VKKNLMLIFGGVSFEHEISCKSAYSVYLALLDLNKYNIYSAYIDKCTGIWYLLDSVSDPPKPIDTDVLPIVSLLPGFGIFSNNKNLEIDVVFPVVHGRIGVDGAIQGVLKDMDIPCVGAGIIGSAISSNKYFCKLLLKSFNIPIVPFIGFRQYDYSLDKEEIKRNVKEVLGYPVIVKPAVLGSSIGINVAYSENQIESCIEEALKYDLTIVIEKFIEAREIECSIIGNEKMKIFSPGEVVVQDFIFYDYDAKYSVIPGNSIIFNIPAHLETNQLLSIKEYAFLVYKNLELRGMARVDFFVEKKSGTIYLNEINTIPGFTDISMFSKMCSHDGLQFKDLIDNLIDYAFQSYINRKKRINFKD

SEQ ID NO: 152 - protein, 1067 aa, Borrelia afzelii
MNKKRTNFSVLLLLIFLLILSFGGFGYYIYQSKLNDKNREIMLNEVKNSVIDRNYKKAYSVAKLLQDKYPQNEDIAMLTNTLAEIANSSPFESNDLQRDSANQILDKIKVQGNVKTNVNENFDIAFNNRYIKDSTITENYSDRNDDVGIEDEDISEFKKSKIPEKINQNTQPKKEDQTIQHPNPKLNVNDQKNLFSLEKLKKNLSENSNNENILNNPQKIENNTQNTNLPKEKNSEHILKTLDNNKYLNNNNAISLKEMPSNSKEESDLSPPSQTIIGKIHRPYSYLIKKELYEILDNINTGRVTLGKNRLKELIKKGLSNKFQKVNELIESLKTKEASNLLLTLIKKDIEPNLIDIPKDPYKKDIFQLNKEKEDNRIQHLEDLKSKVYSIKPGDLENSKTRQQAIKDLNEFLITNPNDAYASKTLAQANKIQQLEDLKSKVYSIKPGDLENPKTRQQAIKDLNEFLITNPNDAYASKTLAQANKIQQLEDLKSKVYSIKPGDLENPKTRQQAIKDLNEFLITNPNDAYASKTLAQANKIQQLEDLKSKVYSIKPGDLENPKTRQQAIKDLNEFLITNPNDTYASKTLAQANKIQQLEDLKSKVYSIKPGDLENPKTRQQAIKDLNEFLITNPNDAYASKTLAQANKIQQLEDLKSKVYSIKPGDLENPKTRQQAIKDLNEFLITNPNDAYASKTLAQAYENDGDLLKAESVYDKITKLTNAKEDYYKLGIIRFKLKKYEHSIEAFDQTIRLDPKHKKAHNNKGIALILLNKNKQAIESFEKAIQIDKNYDTAYYQKGIAEEKTGDMQQAFVSFKNAYDLNKKLNYALKAGIVSNNLGNFKKSEEYLGFFNDNVKKPNEIAIYNLSIAKFENNKLEESLEIINKAINLNPEKSEYLYLKASINLKNENYQNAIPLYNLVIEKNPENISAYINLAKAYEKSGNKTQAISTLEKIINKNNKLALNNLGILYKNQKNYQKAIEIFEKAIINSDIEAKYNLATTLIEINDNTRAKDLLKEYTKLKPNNPEALYALGIIEYNENNNDQTLRELIKKFPNYKKNGNIKKIIGI

SEQ ID NO: 153 - protein, 280 aa, Borrelia afzelii
LMKKFIILIFMLSTSLLYNCKNQDNEKIVSIGGSTTVSPILDEMILKYNKINNNTKVTYDAQGSSVGINGLFNKIYKIAISSRDLTKEEIEQGAKETVFAYDALIFITSPEIKITNITEENLAKILNGKIQNWKQVGGPDAKINFINRDSSSGSYSSIKDLLLNKIFKTHEESQFRQDGIVVKSNGEVIEKTSLTPHSIGYIGLGYAKNSIEKGLNILSVNSTYPTKETINSDKYTIKRNLVIVTNSKYEDKNATQFIDFMTSSTGQDIVEEQGFLGIKK

SEQ ID NO: 154 - protein, 408 aa, Borrelia afzelii
MKVMQDPRLSKYKNTKNLSKKTVEEIDTLSLNKNFSDSEIQGSMLRSWINLIKGNKNKTPIEFKSNNINDLKPGFIRKESKVTKIAKYFLAIGLEKSAKIMSELDDSDIILIICVVFKINYIAPEEKDRIIKEFEELLRNEKRYVKVDNNFAYDLLNKTLGKSKAKSIYKKVTGNDIFIPFDYLSQIEHEQLWALIKDDNIKTLVILYNYLNKDQKKYVFSMLGEEKRREFVKDLAKARQLSMETIEAISNKLKDRFKMQGRLKTDKLDGSKIFVDILSYMDSNEEKNLLNKINMQDLNPAVDNEIREKIFDINVILRIMDNDLHNILREFTDKEIAIIIKDKTDEVRDKMLSNVSKRRKEIILDEEAFLGKISQKDLKTMTLFFINYIKNLTLKGDLTIYRKNEEFI

SEQ ID NO: 155 - protein, 668 aa, Borrelia afzelii
MLIFGFVGLFFFNFFNLHAQGIVTNKDAQEEFKWALNSYNNGIYDDALLSFKKILSFDPNNLDYHFWAGNVYYRLGYVEEALMEWRNLKDQGYKVPYLRHLISTIEQRRGIFSNYELKFKKLVKVASLDNSIYKRPHGYQITSLRADKYGGYYAANFVGNEILYFDVNNNVNALVKDGFSYLKSPYDVIEANDLLYVTLYSSDEIGVYDKVLGVKRRSIGKKGTKDGELLAPQYMAIDKRNYIYVSEWGNKRVSKFGLEGDFILHFGYRTSGYKGLLGPTGVTYLNENIYVADSLRNTIEVFDTSGNHLYSVFTSIEGIEGLSSDSVGNNVIVSSKDGVYKYNIAKKTITKILKADKLNSKISSSILDANNQMIVSDFNNAKVSVYKSDSSLYDSLNVDVRRIVRLGGPKIYVELNVSSKSGLPVVGLKSENFSIANENYYIVNPKVAYNVNASKDINIAVVFDKSSYMKNYDLDQIMGLNTLIESSKNKNFSFINATNVPIIDNIESLTNSIKNTSSLGPYSTDTVKTDVSLKLAGSGLMSKSSRRAVVYFSGGVLNRKAFEKYSLDTIVSYYKNNDIRFYLILFGNGLVDSKLQYLVDETGGAIIPFSSYEGVSKVYDLILEQKTGTYLLEYYYPGPQEPNKYFNLSVEANINQQTGRGEFAYFIN

SEQ ID NO: 156 - protein, 257 aa, Borrelia afzelii
MKRLFLLYFLCSFVFLNLFAQGNSSYVDKQKELAIFYYEVGQRYINVGKIKKGKLFQAKALKIYPDLKKGVDIKLAVKELDARIKDGNSKVVMLEDVKLEEIPGIVHEKIEINDFTNAPKIEYIAQRERSKNQDKIIKFQFGKFARALISQNFDLFDSVIANKVNVMGQFESKNDFISALSRASSKVDADELEYLSVDDYYDLKSLKISKSNDTSFAVNVNAKKNDVTKNFSFWKEHQTLIFTKEDDNDNWFLSSIK

SEQ ID NO: 157 - protein, 442 aa, Borrelia afzelii
MMRSLYSGVSGLQNHQTRMDVVGNNIANVNTIGFKKGRVNFQDMISQSISGASRPTDVRGGTNPKQVGLGMNVAAIDTIHTQGAFQSTQKASDLGVSGNGFFILKEGGNLFYTRAGAFDVDSDRHLVNPANGMRIQGWMARDLEGEKVINTASDIEDLIIPIGDKEGAKSTKNVTFACNLDKRLPVIQEGASSADIARGTWVVNKSLYDSFGNVSVLELRVVKDPNTPNLWNATVLINGEQNSNFTLGFDNEGALASLNGQPSQKGDVLQIPITFNVLGANVGEVGEQQTVNLKLGTVGSYTDSITQFADASSTKAIIQDGYGMGYMENYEIDQNGIIVGIYSNGIRRDLGKIALASFMNPGGLAKSGDTNFVETSNSGQARIGETGLAGLGDIRSGVLEMANVDLAEQFTDMIVTQRGFQANAKTITTSDQLLQELVRLKN

SEQ ID NO: 158 - protein, 455 aa, Borrelia afzelii
LCLRRLKMNKLEEHYIVPKDVVAELDKYIIGQDEAKKLVSIALVNRYIRSRLPKEIKDEVMPKNIIMIGSTGIGKTEIARRLSKLIKAPFIKVEATKYTEVGYVGRDVESMVRDLMGIAVNMVKEEMYSTVREDALIKTEERIVESLFKGSGNSENIDPNEIKAEEKVKEKLRKKLRAGELDDTTIEIQISSKMPFSTIEIFTGGNFEEIDMGIGGLLGNIFDRKKKRELKIKKAKEIILAEELEKLVDHENISDIAKSKVENMGIIFIDEIDKIAAKNRSGNDVSREGVQRDILPIIEGSKVNTKYGIVDTSHILFIAAGAFNLAKPSDLIPELQGRFPIKVELKSLSIDDLKKILKQTKNSLIKQYVAMFKVYNLDLKFSEEAIDRIAELTFNMNLENENLGARRLHGVMERVLADLFFEVPGSKLKKFEINLDYVNKKIQINEQKDLNYYII

SEQ ID NO: 159 - protein, 227 aa, Borrelia afzelii
MKKTIIIALLYGLITNIYPTITSTLKPDEQTNEYTIEKLYQKAMMLKKSKKYNKAIANLKKIINMDQNQVDAHLLLSELEYLNKNWKKAIIKSQDYLKIIDFKDKKNFLDISWAYFLIGEVENSMDYIIKFFQSGKELFKENIFIAIDALFKKSIYHFINNEDVAFNIILTSTFQLALNDDTLFIIFLNNLEIIKQIPFYYFNRKKIKELYLQINTLKTIQNTSCRT

SEQ ID NO: 160 - protein, 379 aa, Borrelia afzelii
MNIKNKLILMLRIVVTISLIACKTPPEARESKNAKIAQPNNEIFQLRDLKDIKNELIRERGHLFYSKEFNEAERLEEAMKQNFSKKKAKEGNEIALKVLERYKTIIKETKEKKEKTNYLKENIEKYLNDAEANEAYIWIPLEIDEVNNLYFEATRKYKNYDLDNALDMYSKAFNRAQQAAKNAKEAKALKETDERMYKQLKALEAASNLPVYSNNKLIKPSPWNGRAFIKERNGHLNLLNINAEDTYFLGETKTSTPIVLAYEEKMEIAKTSNPQEQFKTLELIEQSRKLWEKGVEAKNVKNFRLANELFLESARYLEAYQSNASSELYVIKIGNTLWGISKKLYNDPYLWPKIWFANRQKIQNPDLIHSNWKIIIPAK

SEQ ID NO: 161 - protein, 527 aa, Borrelia afzelii
MKLQKLLFLIIFFLTFLCCNKEEKKEGVSFKISLGAEPSSLDPQLAEDNVGSKMIDTMFKGLITGDPNTGGNKPGLAKSWDISPDGTVYTFTLREKIIWSDGVAITAEGIRKSYLRILNKETGSNYSEMVKSTIKNGQKYFDGQVSDSELGIRAIDEKTLEITLESPKPYFIDMLVHQSFIPIPIHIAEKYGQSWTNPENIVTSGPFKLKERIPNEKYVVEKNDKYYNSNQVEVQEITFYTTNDNSTAYKMYENGELDAIFGAIPPDLIKDLKLRSDYYSSAVNALYFYAFNTHIKPLDNVKVRKALTLAIDRETLTYKVLDDGTTPTRRITPNFSSYSYAKNLELFNPEIAKTLLAEAGYPNGNGFPILKLKYNTSEAHKKICEFIQNQWKKILNIDVELENEEWTTYLNTKSNGNYEIARAGWIGDYADPLTFLSIFTQGYTQFSSHNYSSPEYNELIKKSDLELDPIKRQDILRKAEEIIIEKDFPIAPIYIYGNSYLFRNDKWTGWNTNITERFDLSQLKLKK

SEQ ID NO: 162 - protein, 541 aa, Borrelia afzelii
MNFNKTTKINTKLKLATLIILAISLITCNNNSEKEKLTFKVYIGGAPSSLDPHLVDETIGARILEQVFSGLLSLNTKTGKLMPGLAKNWEASKDKKTYQFYLRDNLVWSDGVSITAEGIRKSFLRILNKTTESAHVDMLKSIIKNGQEYFDGKVSDSELGIKAIDSKTLEITLTSPKPYFLELLLHHAFMPVPIHVIEKYKGNWTNPENMVTSGPFKLKKRLPNEKIIFEKNEHYYNAKEVELEELVYITSDNDLTVYNMYKNNEIDAIFNSIPPDIVNEIKLQNDYYQHKSNAIYLYSFNTKIKPLDDARVREALTLAIDRETLTYKVLNDGTVPTREITPDLENYNYGKKLALFDPEKSKKLLTQAGYPNGKGFPMLTLKYNTNETHKKIAAFIQNQWKKILNINIMLTNENWPVLTNSRNTGNFEIIRIGRIGEYLDPHTYFTIFTSENSQLASYRYSNLEFDKLIRESDFEKDPIKRKKILRKAESIIIEKDFPAAPIYIYSGHYLFRNDKWTGWSPNVSEVYYFSELKSIKNAKHN

SEQ ID NO: 163 - protein, 399 aa, Borrelia afzelii
MEGNDFIKFGSYLRKVRNDKNLTLEMVADDIKISVKYLKALEDSNIEIFPNEVLAVGFLRTYSEYLDIDSRLISTLFKDYKNRLNSSYIGIRSEDKISNLGFSSDKKVPDKKIFFFSLESLSMLKILLGIAGVILLLFMFIAFREVKVYFKKFFKLSRDEKKISNIHEVSFDKKNFWNLSLSEGDFLSLTYGNNIAKYRTSFISDDLVIVDESKKNKNIFNLGEFKEINLDDNLRVKIIYENYYYDKSKIAHVSLESFALNVKYVSETNIDNRFNILNWQFDVKGTEKLPSSDYLTLYSSQKLSNVDLKIDFLNDTFFRYADENNLHGKSFFASKGIPINLAFEKSLILFFSRLSDVNIILNDRNITSFLKEQGKEIFAVQFFWVKTPSGFDLKVSEVY

SEQ ID NO: 164 - protein, 472 aa, Borrelia afzelii
MSLNYVEINTLIKEIPFTNSLIKKIIQPDYKSLILEIYNKIENKKLKILISLNPSTTRFHITKKNFKKNTLKLRFSEFLKSKIQNGKIIKAFQMKNERIISLEILKKDIIILFIKLWPSSPNIIATNQNFKILDAYYRRPKIKETTGEIFLKAKEIHESNKMSDKKIMGLKEEYNNASHTSYSEFLENYYESLSNQIKETNIKELLIEKYKKELIVLEKRIESLKQQIKLIENIENEREKGELILLNINKIQKGLKEIDLLNYKEEKIKISLNQSLSPKENALQYFKAYKKGKSSFNTIQNQLKDNLDKFNLIQSKITMLKVENFITKEEYNQEETAIKKKEKTSKIGLHFTSYGFEIIIGRNAKENDELLRHCVKGNDYWLHTRDYPGAYVFIKSQKNKTPCLDVLLAAGNLCVFYTKLAKKSGKADLYYTQVKNLRRVKNGKLGLVIPKAEKNLHIKLDENLIKKIKNKT

SEQ ID NO: 165 - protein, 599 aa, Borrelia afzelii
MKREIYAFLSNFIVFLCFFLSLIFSYSYFFGENFLEKHRLIAAFFDSILVFYKYFYGFFIFIVCIYFAFFVQQEIKIYLKSYNGYLFSRLYTFLLVFFIIGLFFTFIFNLILPYIIAQRNEYKFSYDRYNLLESEANKISLKIKNIDISLSSNRFFLSSDLSDSMKQKRKHLENLIRIYDKMRIIYVNNEELLTNYYLVKSEYSKIPSYDVDLEKVKKTFSRYPLQSLKKQDFFNIVNEFISQADYYTANYFAYIAYVATKDDSFVSLLNLTLKFINENRNFEKEKMQLISEEKQKNFLYLNTEKFKLAYYGFSKLHKLLPSDNEILNYKNKSLEKLRKRYLFFDEIEKYFEYFGINDVLLLQPDSKRGFYDYIYMQKVVTLNNYSKIIKNFELIRFNNTGNVILHIKIPFATLRGNFVYQNVLDKDNEQSEITLTKVFVSKDSFDTNVLEVVKINENVENLALFSNFTEVGFFLKIQSLSSAFHKVTILNLKLINIFSLTLVLLISPILLVLMGAFFVSLFSKIEFNFNSKVMIVLVSLMIAVFSGIACLFVNYFLIIFTSLLIYVFNSVYISLAILSVLLGFLIFKIIILNYKERHI

SEQ ID NO: 166 - protein, 476 aa, Borrelia afzelii
MKNKFLIGVYFLLTLGISSLVIVESIFAFDESNNNKLSRSSYEQMMIQAFEFVKENYVDPVSDEVIFEGALKGIFQALNDPYSQYLTKKDLEEISKTTVGDYVGIGISIIKKMHSQDKQDKAKDLDPNSACVSIVTPFEGGPAYKAGIKSGDCITAVDGKSVSSMEVDQVVDLLKGKEGTKVKVSILRGKNLTLDFELTREKIEIQTIKYDVINPDIGYVRIVSFNPHTSADFSKALDNLKNRNIKSLILDLRLNTGGYFQAAIKMADDILSKGTIVSTKSRNSSKPVDYKASSKQVLPSDIKIVALIDKSSASASEVFVGALKDNKRAYIIGEKSYGKGLIQHVVPFYTGGFKITSSKYYTPSGKSIHKIGIEPDLEIKSPDFSEEEALIYKEIFDKKLVEGFLKGKKSITEQEIDFFVENLVKENPKYKIDKEFLGKYVFFNYYQDNNKELPIYNLHYDKALKAACEYLSKLGN

SEQ ID NO: 167 - protein, 458 aa, Borrelia afzelii
MKKQNPWISLSEEEKNQIFNFSENYKKFISKFKTEREVASYALDKAKKKGFLNAEEKKNLMPGDKIFYTCREKTVAFAIIGKNPIENGMNLIVSHTDSPRLDAKPSPISEENELVFLKTNYYGGIKKYQWLSTPLSIRGVIFLKNGEKVEINIGDNENDPVFIIPDILPHLDRKIQRNKKSDEIIEGENLKILIGSLPIETKEKNKVKLATLQLIKEKYKIEEEDFVSSEIEIVPAGTAKDVGFDKALIGAYGQDDKICVYTSLESIFDLEEIPNKTAICFLVDKEEIGSTGSTGLDSRYLEYFVSDMIFKIKKSEYNNLHVQKALWNSKSISADVCAAINPLFSSVHDEQNAPKLGYGIPIMKYTGHGGKSMASDADAELVSYIRQLLNKNNIAWQVATLGKVEEGGGGTVAKFLAGYGIRTIDMGPAVISMHSPMEITSKFDLYNAYLAYKAFYKE

SEQ ID NO: 168 - protein, 351 aa, Borrelia afzelii
LNGGNGEAFYMRIAIFIFGILLTSCFSKNGIESGSSKIKISMLVDGVLDDKSFNSSANEALLRLKKDFPENIEKVFSSAVSGVYSSYVSDLDNLKMNGSGLIWLVGYMLADVSLSVSLENPEINYGIIDPIYGDDVQIPKNLIGVVFRIEQGAFLAGYIAAKKSVSSKIGFIGGVKGDIVDAFRYGYEAGAKYANKGIEIVSEYSNSFSDIDIARVMANKMYSKGIDIIHFAAGLAGVGVIEAAKELGDGYYVIGADQDQSHLAPKNFITSVIKNVGDALYLITSESLKNDNVWEGGKIVQMGLRDGVVGLSNANEFEYIKDLERQIINKEIIVPCNQEGYEIFIKPILKL

SEQ ID NO: 169 - protein, 1377 aa, Borrelia afzelii
MKEIKDFEKIKIKIASPDQIRNWSYGEVKKSETINYRTLRPEKDGLFCERIFGTTKEWECYCGKFKSVRYKGIICDRCNVEVTHFKVRRERMGHIELAAPVAHIWYYKYIPSRIGLLLDITASSLNSILYYEKYVVIEPGDTDLKKMQLLNEDEYIEARERYGMSFNASMGAEAIKSLLENLDLDELSSKLRIQMIDKDDKTDKKLLRRLEIIENFKISGNKPEWMIMEVLPVIPPEIRPMVQLDGGRFATSDLNDLYRRVINRNNRLRKLLLLNAPEIIVRNEKRMLQESVDSLFDNSHKRKVVKGSSSRPLKSLSDALKGKQGRFRQNLLGKRVDYSGRSVIVVGPELKLHQCGLPAKMALELFKPFVIRRLIESEAVFNIKRAKNLIEQEVDEVWQILDLVIKEHPILLNRAPTLHRLGIQAFEPVLVEGKAIKLHPLVCHAYNADFDGDQMAVHVPLTPSAQAESWALMLSTNNLLNPANGHPIVFPSQDIVLGLYYLTMEKKNTVGEGKKFLNFNNVILAINNRSLDYNASIYVKIDGKYKKTTAGRVIFNEALPNGIEFVNKTLSDLELQILISKVYVVHGSSTVIEMLDIIKELGFKYATKFGCTISMSDIIVPDEKKAYIDRANKEIAKIQNDYAKGVITGEERYNNVVSVWLNTNEELTNKMMEILKKDRDGFNVIYMMADSGARGSRNQIRQLAGMRGLMAKTSGDIIELPIISNFKEGLSVIEFFISTNGARKGLADTALKTADAGYLTRRLVDIAQDVVVRIEDCGTINGIKVETVKNGEEILESLKEKAVGSYSIERIKNPITGEIVLDANEEISEAKIELLEKIGIEKLVIRSVLTCEAEHGVCQKCYGRDFSKNKPVNIGEAVGIIAAQSIGQPGTQLTMRTFHIGGVAQAGSEDDKISLKNTFILNGIEGFNVRVENGILFTRKGTLKIINVFYEEKIKNIKEIKVSDSQRVIKGIPLFVNNKGVEILSSYIGYVKLRDDKFLIVSEEQEVFLKAGTKLEIEVGEYVESGKVIGTFDPFAEPIIAEVKGKIKFKDIILGTTLKEEINTETGNVEKRITDNVFESLDPRIFIIDSGGVEIASYVLPGDAYLQVEDGQNINIGDIIAKLSKGSEKTQDITGGLPRVNDLFETRIPKNLTEMAKVSGIVQFKSIQKGKRLINILDEYGVEHKHYIPAGKHLLVRDGDIVKAGDMLCDGRINPHDVLEILGGISLQEFLLAEIQDVYRKQGVSINDKHIGVIIKQMMKKVKIVAVGDTNFVYGQKVDKHTFYEQNRKVIEQGGEPAIASPILIGVTKTSLNIDSFISAASFQETTKVLTDASIAGKIDDLRGLKENVVIGHLIPTGTGMGLYKKIKVSENVNSEV

SEQ ID NO: 170 - protein, 1155 aa, Borrelia afzelii
MIKRVHLGQGRADEILDLPNLIEIQLNSYEKFLQLDKLKNKKPLLNEGLESVFRNIFPIKSGNGDVALEYERYYIENDTLNFTEKECKRKGQSYEAVLKVRLNLQFLTTGEIRQKDVYMGTIPLMTERGTFIINGAERVIVSQIHRSPGVVFYKEKDLYSARIIPYRGSWLEFEIDSKKDYLYVKIDRKKRILITLFLRALGLDTREKIIETFYNIKKIKVEEGTKRDLPGQYLAKSINIRENMYYRAGDKITLQDVEDFLQNGVNEIELVDFDGYNDVSGKYFVSSNVILNCLEKEDAFFALKDGSKELPKESVMLAVYGALFPGEPISIDNAENDLKTIFFSERRYDLGRVGRYKLSKKFGSDDLSTSVLTMDDIVNTISHLLRIYEGHDILDDIDHLGNRRVRSVGELLTNIYKGAMSRVEKIAKDRMSNKEVFNLKPQELISVKPIVSAVKEFFATSQLSQFMDQVNPLAELTHKRRLNALGPGGLSRDRAGFEVRDVHYTHYGRMCPIETPEGPNIGLIVSLATYSRVNDYGFLETPYRKVVNGEVTNELEYLSAIDEEKKCIAQANAVFNSDGKYLEDLVSVRISGDYTTTNPKNIDYMDVSPRQLISVSSALIPFLEHNDANRALMGSNMQRQAVPLLFPKPPIVGTGMESVVAKDSGVVVKAKRSGEVILATSNKIVVKPFESENAKDLDEYHIVKYERTNQDTCFNQSVLVKEGQKVERGEIIADGPATRYGELALGNNLLLGVIPWNGFNYEDAILISDRIVKEDLYTSIHIKEFSIEVRETKLGPEKVTGDIPNVSEKILNKLDENGIIRIGTYVKPGDILVGKVTPKSEGDITPEFRLLTSIFGEKAKDVKNNSLKVPHGTEGTVIDVQRITKEDVGNLSPGVEEILKVYVAKKRKLKEGDKMAGRHGNKGVVAKILPVEDMPYLADGTPLDICLNPLGVPSRMNIGQLMESQLGLAGKYLSESYNVPVFESATNEQIQEKLKKAGFNPTSKEILYDGYTGEPFENEVMVGVIYMLKLHHLVDDKMHARSTGPYSLVSQQPLGGKAQFGGQRLGEMEVWALEAYGAAHTLQELLTVKSDDMSGRVKIYENIVKGVPTNVSGIPESFNVLMQELRGLGLDLSIYDDNGNQVPLTEKEEELINKS

SEQ ID NO: 171 - protein, 349 aa, Borrelia afzelii
MEKVFKIKMLKKICFCLLFLQAQMVLSQDQQDLDFNDQYFYFNFQSAYYPPHEMGTNGKSFSQSFKHPNFQNIEPSLKIPANYWGGIKLISYLGYYKNFKALHNPNSIFFKNNGIDVDLNIGLSPVSISFKSMLSFTPIAFLNLYVSNEIGMGWEAFGFKGIGVHIENGKYSNTPEFYSEITIGGRFQFDLNAIFQGDWTHIITVIGNDFTYLINLHANKNQLWKYKADDGKNINGMLIKPYALLAYKMPIPLNTIGLLYEGKTQIGKERNISSWKNKGWGSDIFYHNISIVANFEIAKPLTIGLKLKLSTNPTYTSNTAGLADISKRIATGNSYFYYDSIGISVTHKY

SEQ ID NO: 172 - protein, 1493 aa, Borrelia afzelii
MKKANFLSTNFLILLLVCFVNGNLFSKDIFKFKLVDQYFPFYYKNNKGEYVGLIFSILDKWAKDNNVDIIVEPIGNLNESKIEDEAIYLGLTYNSKLNDLFYFKSELARSISILFSKSSNIKYKNTHSTFLSNFNIGVVKSTIYEDILRLRGANAIFLADNVQELLLALKNDKVDYIYGDCKTLHYIAQRFLGEDLAIFSGDFFYSIKNRVAISRNAPEIIKNLNLDLFSYLMKMPDEYVVSFLDRTSKGNFIDVGLYNDYPPLSFINSKGELSGILVDLWNLLSRQHIFKPIFKGFPKEDIKKTLDGKSVGIFGGIISNDSVFENVNYVVSKPIYPLNFKFYSKGLNNNVGPINSQFIDFNFNNIQLNKNQDIVNNFIDIVNNSYGFIENSITAKYLLKLNGYNGRLKSYDSIFNKNRFLVLAIDNRVYKVIKYILNAIFDDISIESLLQIDKNWLDKEEINSSRINSYKIMNKVKFNIEEKIWLLENNKLNLAVKNWYPIDYVEANNYKGINQFLLDKIRMFSGLEFNIIETSSSLDLKKLIKSGKIDMLNTNTIDSNLDNVFNIKLNSRIPLYIFSNKKRVLPSRSLERFAILDFLYSKNLASNIKSKLVLVNSFKEALLLLYKGNIDGIISDEYTAAAVFEELNVVDVEKLPIFRDLAFDLSLAIYDQDYILKEIIQKVVMRSNVDGQRYLNDWKFDVYYKSKGIRFKNFKFLVLTVIIFYFTFLGFVIIFMFKLSFEQKRRYSFVMNEKKIAEAANAAKTIFIANVSHDIRTPINGIIAATELLDTTILTDVQKDYVRMINYSSDSLLSLIDDILYLSQINVNELHVESQQIDLEREMEMVLKTFQSQCAKKNIDLFSYSKSVFNNYIKGDIVKIKQVLINLIGNAFKFTDDGVIVLNYEEVYRTRVNGNRLVTVEFKVIDTGKGIKRENLSKIFEIFKQEDDSSSRVHEGVGLGLSISRELIRLMGGLGIAVDSKVGEGTTFSFMLPFFLGSELKSKNLSINRFQSINSNSKVLNVLLSKKSIKIFEHCSTLLGHSSNVHYVASFEDAYKFFKKYSFYNFVCVNVNNDNIEESIRFANNIERLSSDVQIIFLFYCLDNKALKNLKYVYVKKPLTGLGISSILSKKEFETEVDFENLAPIDSAFKVKEPISVLIAEDNQVNQKVLKDILIVIGINENFIDIVDDGVKALKALKEKKYAISFIDIRMPRYDGFSVAKEIRKFEKAKNLKPCVLVAVTAHALQEYKDDCFKSGMNDYISKPIHISSIKGILKKYLQFEVDDIGKNEDLSQLVKFPNLDVNRALKELNLSYTSYSELCRGLVDFISINIIDLEKAFDEENLSLIRDISHSISGALSNMRSALYKDFKKIETSKDSIYELKKMYSFIKDDLLRLISNIKENVLFESEIVSENKLYFKNNDQFLNLLNKLLIGIKTRKPREYKGILKSIDKYVLDDNIQVLFSDLRKNLRLYRFDESSKILKEIIEKFSNKRY

SEQ ID NO: 173 - protein, 260 aa, Borrelia afzelii
MDGVFKMIDIQLLDIDNDQPRKSVSLVELEELSISIKENGILQPIIVCKVNERYKIIVGERRFRAAKLIQMTNIPVIEVNIKESCRDFMPLVENIQRENFTPVEEAYAYKNVMNKYSLTQKDLSEKIGKSRTYISNIVRILDLEQEILNAVHRKEISFGHAKVILSLKDKQDRYNLYLIILKKKFSVRDAEKYVKNFYKSITKKKEVEQDPFLSNIKEFLFDKIQTKIDIKGNQDKGKIEIEYFTAGDLRRIVSFFGHIN

SEQ ID NO: 174 - protein, 639 aa, Borrelia afzelii
MNGRFMNYVASNIQVLKGLEAVRKRPGMYIGSVSVNGLHHLVYEVIDNSIDEALAGFCDRIDVIINLDNTITVIDNGRGIPTDIHEEEGISALELVLTKLHSGGKFNKGTYKVSGGLHGVGISVVNALSSFLEVYINRDGKIFRQTFSKGIPTSKVEVVGESSITGTKVTFLADSEIFETLDYNFDVLEKRLKELAFLNDKICISIEDKRFGKEKSSKFYFEGGIKSFVDYLTNDSKAYQSESYYIDGLINDVIVNVGLKWTESYSDNILSFVNNINTREGGTHVMGFRSGLTKAMNEAFKNSKISKKDVPNLTGDDFKEGLTAVISVKVPEPQFEGQTKSKLGNSEIKKIVEIIVYEHLLKIINLNPLEIDLILGKAIKAARAREAARKARESERKKNAFESLALPGKLADCTSKNPLEREIYIVEGDSAGGSAKMGRNRFFQAILPLWGKMLNVEKTREDKVITNDKLIPIIASLGAGVGKTFDITKLRYHKIIIMADADVDGSHIRTLLLAFFFRYMRELIENGYIYIAMPPLYKIKYDNRIYYFYDEKEKEKFLNSIETKNRNSILLQRYKGLGEMNPTQLWETTMDPARRKMRLMNIDDAVEAEKIFVTLMGDLVEPRKEFIEQNALNVINLDV

SEQ ID NO: 175 - protein, 586 aa, Borrelia afzelii
MFKVIKCNELNEKLINKKVEINAWVKKIRHHGKFTFLDIRDRYEKAQVLITEEHLLKIVEKIKLEYCIKIQGLLIKRPSNMINANMTTGYFEILAKNIEIISKCNELPFMIEDDNNASENSKLKYRYLDLRRDSLKNKIILRCQATHLIRNFLVKRKFLELETPTFVKSTPEGARDFVIPSRIHKGSFYALPQSPQLYKQLIMIAGFDKYFQIARCYRDEDSRGDRQPEFTQLDLEMSFVKKENIFKLIENMLFSIFKNCLNIKLPKKFKKITYKMAMNKYGSDKPDTRFELTLQDISRNLKNSEFNVFKDILNNKGSIKTLIVKDKADTFSRAKINNLEEIAKLYKTQGLYFTKIENNKFSGGIAKFLKTEEQQLIKAYSLENNDIIFFIANNKWEIACKAMGQIRIKIANDLGLIDENKFEFLWVYDFPLFEYDENTKTYIPAHHMFSIPKKRYISNLEKNPNKAIGEIYDLVLNGVELGSGSIRIHNKELQQRIFNIIGFQKEKSEDRFGFFLKALEYGAPNHGGIAIGIDRLIMLMTKSTSIKDVILFPKNSFAASPLDNSPSKISNEQLKELGINIAADDT

SEQ ID NO: 176 - protein, 229 aa, Borrelia afzelii
VKTIDHELYYEFRIADDVKMIYTKKPFHLNLKELSNDNLNFVPKSKKIKYLKQLHTDIIYEVKDDFINFQEGDGLISSSLDVALVTYFADCLPIYFYDSVKKIIGLIHSGYKGSFSLIILKMLFMFEKMGSSFKDLKIVFGPYNRSCCYEVSEIFLKEVSNKFSKSLLNTAFSIRDNKIYFDNASFNFNLLSSFNLNIYSSKLCTYCSKNLYSYRRLREGQSYALIWRI

SEQ ID NO: 177 - protein, 427 aa, Borrelia afzelii
MHSYIVEGGFKIGGQITASGNKNSALPCILAALLTDEDVILENIPNINDVKVVLDILSDIGADIVREGNTLKIKVLDIVKTEIDSSFTDLIRASILLLGPFVSRFGKIDMALPGGDVIGKRRLDTHFYGLCKLGAKLSIKDERIVLKANKLVGAEMFLDEASVTATENIIMAAVLAEGNTVIMNAACEPHVQDLCNMLNSMGANILGIGSNVLEIKGVKKLSGTIFRIGADFMQVGSLISLAALTGGELEIKKADPQHFRLIRHIYSKLGINFEYDRENVYVRDKQELKVKLDFGGQIPKIDDGPWPAFPTDLMSIIIVTATQVEGTVLVFEKMFESRMFFVDKLIKMGARIVLCDPHRVVVTGKAPLKGSVLSSPDVRAGMALLIAAFVAEGRSEIQNVYQIERGYEDVASKLINLGAKIKRVKSQ

SEQ ID NO: 178 - protein, 209 aa, Borrelia afzelii
MERKVFSKDGKEIRTINLDDRVFNIEISHGSIYNAIKNELSNLRVGTSSTKTRSEVRGSSKKPWKQKGTGRARVGTKRNPVWIGGGIALGPKPRDYSYRLPKKVKRLAFKSVLSLRASDENNFKVIENFNIESGKTKDLALIIKNFASFNGKVVILLGNDDQMIKRAGKNIRDLKILSFDKLRVVDLFYAKNLIALESAVNKLNEFYVK

SEQ ID NO: 179 - protein, 2162 aa, Borrelia afzelii
MIDFATILVNLFLVSIVLFVYRQYDKRSRALDKIKKFIDLTKVNLEDFIEDKTKEINDLAVDMEAYQRSSIEIIKKIEEVQQKIKNKSNDFAEVEKKIAYHDSMLKDLDEMTFKVQENIERLQVDGKIVDKLSKTLKGFNTQIDSVESNLNSVLEKFDKTNKENLESIKIASWEKFDTNIKDLVFKMDNLNKEIDLYEKDLANIEERKKDILVKGNEKLDLEFNDFLEKVEFNIVKYNKEIENSFGFYEDKYKLIENSIELIMESVKNKINEKEDFILNRLNEELQNKFKDIFTYVDDRSKEIQDKLEDKLILVDDEISSMSSSFKDNVYSRINSLEESIRIEMGKYEEQVDDVFDKFRSQVELNLKNIYEDYEDKINQVDKNIKERVELSLLDLNSKMESVQVGAIDLMKRLEDDSNKIYLEFKNKFEEDIKVFSGSFKDDINQLKMQLESQLLDVDSNIQDKLIKLNDNLISNFEEIGGKFNNNYSNLSDSINAKYTALFESLDSSSSKFEDQMESKYKVFTDKLTAEMDDFSLIYGKKFDTFSQEAINNYQEFQDLNKKLENEIGSLCNMLEENQEILKRDFNTSLINIKDEIGKNIIEFKDRYYDEVNIFVSQLEESKLQYSKWQSEMDSNLKNIESQINKTNEEFLSLIQIQKDKGIELSESVFNDLSDHIQKKAIDMHGSWKDELIALNKSLLDIKISSEELLSSATLKIENLEKDINDRMEYVLLKTGDIESLVIEKYKELKDMSYSQSDEAILEIKEFINRQTEIIKDKSVFMLEDLNKKFDDKNNFVISKIEECDYKLKDFKIESEDVLNNFKSDLNEFIESKLQIVSDIKSDNQKQIDDFLDRISKDILNRKDSINNEVDIKLSDWQSKLNEITVKIENLLSSGKVDLDLIDSEVTTKIKELKFSIESLESYYLEKIDEFRNQGAIYSDELLQDIMNHFNKETRELEENLSKKFAVVLNNSEEFVKEVDSLLQDKRTDIASFQANIDITLDSLSVKFNDINKEINEKYNEVISNYRGYSENISSKLENEIMHEIENLNRRLTDRMDSLSKGMDENLQKLKESFDVSKYQVEKFELKVKDLTDDGETKISEFVKEIEQYYKSRLEEAIDYRRTIDSDIMQAKERFGEITNDLKNNIESKSEFLNDLYKERFKLIESNFEERYSTFLIESEGAISKIRDEIYKTLTINDENLQIKIAEMDHNFEIIEQRSKDILEFEKELRDKIQDCYGVINSQFGEIKVSVEEDIKNHFEVCIKKANTLIDDDIIKYENEIHKRIDSLKSIENTFDSIEKNLNDKVNGCIDKIANDFNLKYIELEERCNEGQLNLESKIDNKIKAIDNLASSQYDGLEKKYADMYDEFLERLNSYITTLSEEFKHSNKEMIFELESQLKNLKNLESDLNNVEKDVIRLKEESYHNVSSHLKLLEEDFFKDLKIRGEELKYSLENFVASYNDKIQNLEYDLSKNLENKTELIQSFHLDIEQKMKNDKENFYLDFTKEFSSKKKDMESEIALMETNITGRVDEFIDFVNNRQNIIDSWFLNIKDDVKNWQEKSYSTIEKKINLAELGIKSFENDILNVKIGLESFKDGFEVKAEEIFSNLQSEAKKIEQSVHLDFKNIGESLNLKVLDLERFVDFKVEKIDEKVNKKTEDILTQAEVKFLTQQKNLEDRIFELNQKLEQEFTTLSSNLDKVRREMVDVISSDKESFEGQIELMHKNISEFSEKISLYRSNIETSIENEYSSFSKSIKSEFGLLEDELKKSLKHSTLEIESVKNDLQEQIDKFEVEFKKNHKELLKEVDTNVLELESKILNCDITFNKFISDIKDNLVEYKSDLRKEFEDSYDKLNFQIENFKKLDAELEKNNSIFLEAYSLKDKLEKLWETLKNEIDLAQEYKNNFENVNKEFYNIQKETLGIIETFNDLKLEHESIQAIKNDLNKFFEFYSSFDSRYKSLVESYDEMQIYKAKIKEISVEQRTILDNYERISNKESILKSTIESVDKNFDLINEVEKRFNTLSKESTKFQNNLKDMENVVSNLLLNKGLSEEVLVNAQNLKEMLLDIENRLKNTLTMREKVVKSETRLENLNIAAEERIKTLGILVKTDSKYQDNVGLNNETVRNSVIKLMRQGWSAEEISRATKLSIGEVELILELGISNKGD

SEQ ID NO: 180 - protein, 635 aa, Borrelia afzelii
MGKIIGIDLGTTNSCVAIMEHGKPVVIQNSEGGRTTPSIVAYTNKGERLVGQVAKNQMVTNPENTIYSIKRFMGRRFEEVASEIKMVPYKIEKGLNGDARVNISNIKKQMSPPEISAATLTKMKETAEAYLGEKVTEAVITVPAYFNDAQRQATKDAGKIAGLEVKRIVNEPTAAALAYGIEKKHEEIVAVYDLGGGTFDISILELGDGVFEVKSTNGDTHLGGDNFDDEIIKHLISEFKKESAIDLSNDKMALQRLKEAAEKAKIELSGAQEASINLPFITADANGPKHLQYTLTRAKFEQMVDHLVQKTKEPCLKAIKDAGLKASDINEVILVGGSTRIPAIQKIVKDIFGQDPNKGVNPDEAVAIGAAIQGGILTGETKDMVLLDVTPLSLGIETLGGVMTKLIERNTTIPTKKSQVFSTAADNQTSVDIKVLQGEREMAAQNRILGNFILDGIPAAPRGVPQIEVSFDIDANGIVHVSAKDMGTGKEQKIRIESSSGLSESEIDRMVKDAEAHAEEDKKLKENIEAKNTANSLIYQTEKSLKEYSEKISIEDKETIENKIKELKESLEKEDISLIKSKTEELQKASYKIAEMMYKDSSQQNASNQQENGTQNNTSEEGKEADYEVVDEDKK

SEQ ID NO: 181 - protein, 187 aa, Borrelia afzelii
MEKKETKNETEKTNKQDNKNTKSQKKENLNLVNSDKKITELENEISNLKDLYLRKQAEFENFRKRLEKEKDNFVKFANETIMKDVVNFLDNLERAINSSKKSKDFDNLLTGISMIENEILSIFDKKYNLKKFGENGENFDPSRHEAISIEEKEDLKNPEIVEVYQKGYCYNDRILRTAKVKVAQSKN

SEQ ID NO: 182 - protein, 248 aa, Borrelia afzelii
MKDLNENNDNNKGFFVALTSIATVCIIIFLGTIIFFPNKNLTSDIAEKNIVLEETKDQNTLENVDQNEKSLKVSETPNEIIIDLTQDLNKEKKTTPQKIPNTSQKSKIIEKSQPTPQKIPNTSQKSKIIEKSQPTPQKIPNTSQKSKIIEKSQPVAQKDLNIDNIYDPNTEYYIQFVSLSDPINADNYIQKLLKYNIVAKIYSATVDNKDIYRVRSGPYKTKSEAKADFKKIAGISEFKETYILPVNK

SEQ ID NO: 183 - protein, 501 aa, Borrelia afzelii
MNKIKNRIFMYFIILLCISLFGAANNTINYSSIEIPLEDLSEEFKDTENKNDQTNALKHLNKNIASYKDLKKGKDLKLPENIRDKKLFKKRMDENDLKSVIENYENKIKNIEKLLKTKNQKASANENKKIELIEKKAKKYEILTNKLKNEIVEIKKLLNKKSRPKDAENYEKINIENIDDDDDDGDDDDFEENYEYNDEIEETNEDNYPSNEGIINNLKEKLYENEKYYAINEKKFDELEDRINDNENIILDLQRELRNFKKKDDSNKNLEEIEENLSLIGKIINGLKEKISANEAINKENQKKIRTDKHKLKELEDKIKENEETILKLQKELNNFKKKEISQKSLNEEAFIPSIPNKNDDLEENVKLEKKYLKPAEKNESQDLEENVKSAPKTTMIKTADFQIYPDIYLNNYNFKEKGDQFAFKKENTYYIEIDPTNNLNGALKNHEIISKYKFEKYFINPTLKNKEEFFRNLIEVKNIHELGIMYKSLKPEFKQIKIIK

SEQ ID NO: 184 - protein, 650 aa, Borrelia afzelii
LILTSYFKQIALFIIFRLCYIIKKVKIKLKRKIYMKKQFDTEVNDLLYLIIHSLYSHKEIFLRELISNASDAIDKLKFLSLTNEKFKNIALEPKIEITFDDKSILIKDNGIGMNEQELTNHLGVIAKSGTKEFINNLKQDEKKSANLIGQFGVGFYSAFIVSEKVEVTSKKALESDAYIWSSDGKTGYEIEKAKKEDPGTEIKLYLNKEGLEYANKWKIQEIVKKYSNHINYPIYIKYNEPIMKDGKQEGIEEKEEKLNETTALWTKNKSEIKTEEYNEFYKNTTFDYENPLMYIHTKAEGNLEYTNLFYIPSKAPYDLYYPNTKPGVKLFINRIFITDSEGSLLPNYLRFIKGIIDCQDLPLNVSREILQQNKILSKIKSSSVKKILSELEKLSKKNPEKFSEFSKEFGRCIKEGVYSDFENREKLISLIRFKSSSVDGFVSFKEYKERMNESQKSIYYITGGKENILKENPIVTAYKEKGFEILIMDDELDEAILNLIPEYEGLKLKAINKNETSNELKDENFKKIEEEFKDTLTRVKEILKDQIKEVNLSATLIKEPSAIIVDSNDPTYQMQKIMLSMGQEVKEIKPILELNPNNKIVQNLKNLEPEKLEKISILLFEEALLTSGMPSKNPRKFINIINEFLEKDLL

SEQ ID NO: 185 - protein, 229 aa, Borrelia afzelii
MLEIISLGGGVINSNQINIEFIKNFKNFVFKWLLENEKRKIILIVGGGKVAREYQDAYKKINPNFKVSELDEIGIMSTKLNAEFLCKVMNPLCKDKIVTNPLKNFSFKGKILIASGWKSGFSTDYIAVKFAEKFNKKDIINITNVNQVYDKDPKKFKNATAFKKLNWEQLQNIVGQKWNPGLNLPFDPIATKLSSKLGLTLYIVNGNNIENLEKVFNKNNDFLGTVIVK

SEQ ID NO: 186 - protein, 1161 aa, Borrelia afzelii
LLKIKFYFDKIILGMSFRAKFIHLHVHSDYSLLDGAAKISDIISKAKKCNMSHIALTDHGNLFGAIKFYKEAKKAGIKPIIGIEAYMAKTSKFLKKHDDLGKMSYHLILLAKNELGYKNLLKLTSISYLEGFYYRPRIDKEDLEKYSEGLICTSACIGGLIPRLILANRFEDAKNEILWFKKVFGNDFYLELQRHGIKDQDIVNERLVEYSKELGVPLTVANDSHYVNREDASAQDIIVCIGTGAKKSDENRLKMETNEFYIKSQEEMCELFNDLPEALENTVRIAEKCDDFKITFPGPILPDYQIPIEFNTLGEYLEYLTLEGLKFRYKTLTSKIKDRAFYELSVIIRMGFEGYFLIVWDFIKFAHDHDIPVGAGRGSGAGSIVAYALRITDIDPLKYNLLFERFLNPERISMPDFDIDFCFEGRDEIIKYVTNKYGEDKVAQIITFGTLKAKAVVKDVARVLDIPFAESNELTKFIPDGPKVSLKEVLDDNSLKEYFTSKPVYKELMNAALVLEGMNRHASTHAAGIVISKTPLTDYVPLYKDYKQGSISTQYTMDLLEECGLVKMDFLGLKTLTLIKNAENLIRSVNPDFKIKNIPDNDVKTFKMLGEGRSASVFQFESEGMQQILKDAKPDNIEDLIALNALYRPGPMQFIPQFIAAKKGVKRIKYPHPDLKEVLRPTYGVIVYQEQVMEVAKIIGGFSLGKADILRRAMGKKKEDEMNEMKVDFLRGAIEKGYDKEIASEIFELLKPFSGYGFNKSHAAAYSLIAYQTAYLKANYPEYFMAANLTNEINNNDKLSYYIEESKAMGINVLKPDINRSFREFRVTDSGISYGLNGIKNLGGIVVDLIIDEREKNGKYSSFEDFIRRVDDKVINKKFLESAIKSGLFDSLNQNRKTLFENLDRLIEVVSEDKNNKRLGQNSLFDVLESQESIQQSFNYQVLKEYSYSELLGFEKELLGFYVSGHPLDPYKKAINNFSSLNVLKDLAAKKDSIVQFSGILNSVKIIQTKRNNSRMAFGVIEDFKGAIDIVVFTESYERYKNFLLEGNVIGVIGRLTFNRDKFSIVVEKVVNIERLSEDKVNNIHIKFLSNKLNDLQLLNSLKESISNFEDNSGFSNVYFYLRENGKDLKLKMNSILNFGPDEDKLDKLRRCVIVEDVWVD

SEQ ID NO: 187 - protein, 264 aa, Borrelia afzelii
VNNFLIKLLLFLLVFSNSYVAFSKNSNVLIITAMDSEVEQINKLMSNKEEIVLKEYGLNKKILKGKLSNRNVITIVCGVGKVNAGVWTSYILSKYNISHVINFGVAGGVVSDKYKDIKVGDVVVSSEVAYHDVDLTKFGHKVGQLMGLPQKFSANKNLVDKATKAVKSKAVSSNSYSGLILSGDQFIDPAYINKIIGNFKDVIAVEMEGAAVGHVSHMFNVPFIVIRSISDIVNKEGNELEYSKFLKLAAFNSAKVVQEILRIL

SEQ ID NO: 188 - protein, 619 aa, Borrelia afzelii
MKNHILYKLIIFLTTSAAIFAADALKEKDIFKINPWIPTFGFENTSEFRFDMDELVPGFENKSKITIKLKPFEANPELGKDDPFSAYIKVEDLALKAEGKKDAQFKIDVGDITAQINIYDFFIKISTMTDFDFNKESLFSFAPMTGFKSTYYGFPSNDRAVRGTILARGTSKNIGTIQLGYKLPQIDLTFAIGGTGTGNRNQENDKDTPYNKTYQGILYGIQATWKPIKNILDQNEDTQSVIAETPFELNFGLSGAYGNETFNNSSITYSLKDKSLIGNDLLSPTLSNSAILASFGAQYKLGLTKINNKNTYLILQMGTDFGIDPFASDFSVFGHISKAANLKKGISLDPSKKAEDIFDPNGNALNFNKNTELGIAFSTGASIGLAWNKNAGEKESWKVKGSDSYSTRLFGEQGKKSGVALGISYGQNLYRSKDTEKRLKTISENAFQSLNVEISSYEDNKKGLMNGLGWITSIGLYDILRQKSVENYPTSTLSANENNQAGQSSTGTQAITPNLTFEDAMKLGIALYLDYAIPIESISTEAYVVPYIGAYLLGPSNKISSDATKIYLKTGLSLEKLIRFTTISLGWDSNNIIELANKNANNAAIGSAFLQFKIAYSGS

SEQ ID NO: 189 - protein, 476 aa, Borrelia afzelii
MSIVIDSFREISKIPRCSKNVKGIINFIKERAKKFGYSFKEDSVGNIVVQIKSNNNIDMPPIILQSHVDMVCEKNESSLHNFETDPIKIVEEDGYLKGVGTTLGADNGIGVAMMLGIMSEADSFPHPDLELLFTVDEEIGLIGALGLDSKLCNGKSLINLDGEEEGYFLVGCAGSRLVEIVFSPQYNLATKKTKVEILLKGLKGGHSGADIHLDLANSLKLMFFALFEIKANIDFEIESIFGGESSNAIPNEAKALICINDSDYELLSKELKLFVFKVKSIYSLENEFDIIVNKKEFSSVKVLDENSKSRLLNMGMGFLHGVQRVENYENKLIKTSLNFSSLFKMQDEYIFTFLIRSLLDSDKEYVFNHLQSISDLSGASWRIIYDYPSWKSDKNSSLLKHLQGVYKEMYLEDANVSLIHAGLETGIISSKLGGIESVTLGPWIESPHTTRERVNISSAIRVYDFLKKSLERFQKF

SEQ ID NO: 190 - protein, 430 aa, Borrelia afzelii
MARVKGQKVKECSFCGLSVAELGGNVVISNGVAICPECSKICHNLFKEKLCKSLDSRSNGLPTPKQLKDHLDMHVVGQEDAKKVLSVAVYNHYKRILKNNKYDDGIEIEKSNILLVGPTGSGKTLLAKTLAAEMNVPFAIADATTLTEAGYVGEDVENILLKLIHAAHGDVSLAEKGIIYIDEIDKIAKKNENVSITRDVSGEGVQQALLKIIEGTIANVPPRGGRKHPYEDTIEINTQNILFICGGAFVGLENIVKNRINKSSIGFSAIEKKNIRDDASLKYLEMEDLIKFGLIPEFVGRLPVHSYLEKLSKEDLIKILVDPQNSIVKQYYHMFKMDNVELVFEKDALESIVDEAILKNTGARGLRSILEGLLKDVMFEVPSISKTKKVIVTKESVLNADINPLILVGNAIKKPWAKELYEINLKYDKK

SEQ ID NO: 191 - protein, 813 aa, Borrelia afzelii
MQLKNLGQKSYMKSILNMIKNRKEDLPIVILKENVLFPNVTLWVTFDNEYVINSIAQSMLEERLILFAYPNESNYDESGKEGVKNLCSVGTYSKLIQVIKVSKDVVKVLVECQSRVLIGSVSKKNDYLRAKVTFVSDAEGLNRELFTYAKFLKETYEVYRNSLSLKSYDSDNEPINYFENPSKLVDIMASNSNLENSVKLDLLQELNVKTRIEKLIVNLNIEIDLLDLKKDINSKVRAKLDKGQRDYFLSEQVKEIQKRLGKDENEYIDRLNSKDIPEDVKSKVEKEISRLSKMQMNSPDANIIRSYIELILDLPWNENTVMKNHLSEIEFILRNSHYGMDEAKEKIINFLAVYQINSKVKAPILCLVGPPGIGKTSLVESIARSLSREFVKISLGGLRDEAEIRGHRRTYVGSLPGVFISAMKRSGKSNPVILLDEIDKINNSYKGNPESALLEVLDPEQNYKFIDHYLEIPYDLSNVLFVTTANSLNGMSKPLLDRMEIIKVEGYSYIEKLEIAKIFLIPSIIKESFLDKVYIRIEDDVIFNLIRNYTMESGVRGLKRVLTNLIRKLVRELLYKYSKDQIIKGNFYSPSSLIHGNNSLFTHDPDIPGIYKIININNYYNYVDTEYNLDLIKIDSSGFVYGLAWTNYGGTVLPVEATKFEKKGDIILTGSLGTIMKESAQLAYSIVKTYSSRLNFDVKESPEIHLHFPEGATPKDGPSAGITIATAIASILSDKKVPLDLAMTGEVTLKGFVLPVGGIKEKVLAAYRNGINKVILPKDNKKDYFKLPEEVKDNIDVKFVSSLEEVFDYLNII

SEQ ID NO: 192 - protein, 698 aa, Borrelia afzelii
MTTLFKILALRKSKTFYVLQIIKLIILFYFLIISPANLNADFEYKVGKGDTLFSIAIKYKAKVNDLKRINKLNADNIRVGQILIIPSDSSLDPNITHKVNHSLNSLESIKKGVILYTVKEGDTIESVSKLVGLSQEEIIAWNNLRSKDLKVGMELVLTEPDFLKPYVVKKGDSLSKLSQDFDISSKDILKFNFLNDDKLKIGQQLFLKRATKNIDFHYVKKGETLGRIAYIYGVTAKDLVTLNGNRAVNLKAGSLLNVLKIVNDDLEKSVEEDLKIEKKTDNQFIYHSVAVGETLYSIARHYGVLIEDLKNWNNLSSNNIMYDQKLKIFDKKLLFDSSIAKSKNDLYIKNKVDSSSNSSNEVKTIVNLPSSKNKKLNLNTFRITTNQDFFDISSLVILDSKIPIFEVVGDFYYWYRPKKISQPSEFYSEDWHSPLNSYKKATQLFKSFEKLVNSRFNKGSRLKDKLIILDPGHGGLDPGAIVKSRDGLGNEVFVVEDEYVYDIALRLYVYLKEEGANVELTILAPDHLIRNSVFANNTFVNVKNEVYNDYDLNKNDTVDSWINGTPSGLKKRLVVVKNIVNKYKHIKDKDIAFFSLHADNSVGAPKSMGFYYQKDDEKKYDIHSKSVAEKITEGMKRSFYIKGQNLHVLRNNVVMTKLLIEVRNLAFPEEAWSIRSSKLRDQDSKILANGILKILENN

SEQ ID NO: 193 - protein, 562 aa, Borrelia afzelii
MFRKLKKSKTYIIIISITKFSENNLLSIISNIKYLIEHKQLAYKIHWTFPIYFFEILREHEELNKWLFERFKTNTDIYMPGTYSGSPHEYMLHDEIHLDLYWALKNPFKSGYKDIFQNTPIMLYIYNIEKFRKKVTELYRKLNFNYTEGIRQSKNNKTYLIFYKNNCQYLYEVQKIDSPRSNVETLIYFYEIKETYDNQELKNFLLYLKSLENSLHSIKIQNLAGSKLTTELLEIPKFNSLKEQEPIINFQNKRLKDYQINEKSLREFLINKHQEEIVRNSESIIPKNLEYNMEGNFTLSHDQYNIKFENGKLNKIKFKDKKVEFLNTSRTYFKILSKKELIKEASIESSFSFSNEKILGIKQYLAFNSTTKSTIDFFIDETISSFFVSIKIKWPSKINLDKKALKKYNPDYLLEYSALEIPVFEITKGTNLKITAKYSDLDTYEKIIITKNNPKGYINGTEFLISKGNDKNSNFFISFLNVEKQIIHTINYKIEKINSKKWLILNIGGSYNKVKIQDVINYSQTLNLMILPLNNNFDNKIRLNSKIKNLIFYTNIKKYENK

SEQ ID NO: 194 - protein, 545 aa, Borrelia afzelii
MAKDIYFNEDARKSLLSGVEKLSNAVKVTLGPKGRNVLIDKKFGSPTVTKDGVSVAREIELENPFENMGAQLLKEVAIKTNDVAGDGTTTATVLAYAIAREGLKNVSSGINPIGIKKGIDHAVSLAAEKIRQSAKKITTKEEIAQVASISANNDSYIGEKIAEAMDKVGKDGVITVEESKTFDTTISYVEGMQFDRGYLSPYFSTNKENMSVSFDDAFILIYEKKISSIKELLPVLEKVLGTNKPLLIIAEDIEGDALAALVLNSVRGALKVCAIKSPGFGDRRKAMLEDIAVLTGGVLISEELGLTLETVEIEQLGQAKTIKVDKDNTTIINTGNKEQIKERSELIKKQIEDSTSEYDKEKLQERLAKLVGGVAVINVGAVTEVELKEKKHRVEDALSATRAAVEEGVVPGGGSTLIEVAMYLDTIDTSKLSYEEKQGFEIVKRSLEEPMRQIISNAGFEGSIYIHQIKTEKKGLGFDASSFKWVNMIESGIIDPAKVTRSALQNAASIAGLLLTTECAITDIKEEKNTSGGGGYPMDPGMGMM

SEQ ID NO: 195 - protein, 253 aa, Borrelia afzelii
MLGDFMYKLVLVRHGESEWNKENLFTGWTDVKLSDKGVDEAIEAGLLLKQEGYFFDIAFSSLLSRANDTLNIILKELGQAYISVKKTWRLNERHYGALQGLNKSETAAKYGEDKVLIWRRSYDVPPMSLDESDDRHPIKDPRYKYIPKRELPSTECLKDTIARVIPYWIDEIAKEILEGKKVIVAAHGNSLRALVKYLDNLSEEDVLKLNIPTGIPLVYELDKDLNPIKHYYLGDENKIKKAMESVASQGKLR

SEQ ID NO: 196 - protein, 360 aa, Borrelia afzelii
MAIKKRKFYKRFIYKELVYMKRKAKSILFFLLSTALFAQETDGLTEGSKRAEPGELVLDFAELARDPSSTKLDLTNYVDYVYSGASGIVKPEDMVVDLGISNWSVLLTPSARLQAYVKNSVVAPALVKSESKRYAGDTILGVRVLFPSYSQSSAMIMPPFKIPFYSGESGNQFLGKGLIDNIKTMKEIKVSVYSLGYEVDLEVLFEDMNGMEYAYSLGTLKFKGWADLIWSNPNYIPNISARIIKDDVPNYPLASSKMRFKAFRVSKSHSSKEQNFIFYVKDLRVLYDKLSVSIDSDIDSESVFKVYETSGAESLRKLKAHETFKRVLKLREKISMPEGSFQNFIEKVESDKPEESSSEN

SEQ ID NO: 197 - protein, 466 aa, Borrelia afzelii
VQIKEIYFGPKILDDKNSNSKLTNFDFKVVSFELGSDHYLVDIMQVKEIRKSSNFTYVPNAKKYVAGLDNLRGEIIPIIDLRIMFNLEFNKKDLEDIMVLKHKDLLIGVIVDKINNVFSIDSSLIQDPHPVLSQDSLINYIKGVVDYNEKLYILLDVFKIFNYGEEERVLTSGQNFVEKTDFVDDCGNLDILENAKSNLSNNGFSKNTNNNENSTVNNIAAFNLENIKKNLLKFSFNASLVNDVFLEKVGVKFNMVDTDCLPYDSFLNEFYSKSSGNLWGADCLEEFQNEIVKNRLNFMDNLNSIFNILEIGCGNGRETMALVNALSEYYVGPFKLTAIDNDLSKVVETSRLIFSESEIGISEIYRRNSFEQSPGVYKFKSEILNNVLFEYSDALFSDLPDHLGMVFLKDVLCFLDSKDQILILNIIASKTIKGALLFLGDNEELKNNDIFIKEKSTKYFNLYRRV

SEQ ID NO: 198 - protein, 753 aa, Borrelia afzelii
MLLKLKYSFVGFLLLFLIFILLLFSMIFNFVLCGYLEDYYKQLTRAQLRRAAFSTQSFLDTLYVIVSGAASNLALETISEFAIYENRGKDFSESELIDLRKNPKFVIDSVKVNKKYRQYLYNFMANLKNDTFFEEFAFFDFEGRIIVSTRHENNMDFGHSEANTNYFKKAVEDYKQDQLKFIGWYSNLSEGISAEVAIRSRQSEKKAFAIIVPVYSPEDKLVCGYLAGYLLNDVLADSFDRFRFGFYKRGNFIYVDPNNIAVNPFEEYNEISRVSSKFLNTLKDVFSKPPLLSNIPTEVSVYTIDRIFFPEMGEECYYALLPISSKLGEKGGVLIARLPYKDIYGVISSIRFQYVLYSALGIILLSIVLLARIDRVISFRLNAIRVLVQDMVNGSLDKDYALDDGDDFSDELSMLSLRVVKMKKAISVAIASVLRNISYVNKASLEVASSSQNLSSSALQQASALEEMSANVEQIASGVNMSANNSYETEQIALKTNENSHIGGKAVEESVIAMQDIVEKVSVIEEIARKTNLLALNAAIEAARAGDEGKGFAVVASEIRKLADLSKISALEIGELVEDNSKVATEAGVIFKEMLPEIEETANLVKKISEGSSKQSDQIAQFKMALDQVGEVVQSSASSSEQLSSMSDKMLEKSKELRKSVLFFKIKDSKIENLEDGEYDFRLMDCPEDSFKDENQDLKSNGISTLNGSRHNNHSLSIESEPSVRAINKRVDPKKAIDIADKDLNFDDDFSEF

SEQ ID NO: 199 - protein, 317 aa, Borrelia afzelii
MDLISFSVPGNLLLMGEYTILEERGLGLAIAINKRAFFSFKKSDSWRFFSKKKEIDDFSLIENRNDFVFKMFAYLNQNCFFNLESFAYDVYIDTSNFFFNDGTKKGFGSSAVVAIGIVCGLFFIYNATNVVEKGEIFKYCLEAYRHSQGGIGSGYDIATSIFGGVVEFEGGFAPKCRQLNAVEFNDFYLMQGLQAVKTTDSIYEYNKHRDSILDFILKCNSEMNKLVLNVCSSKSALISSLRKAKELGLAIGAAIGVPAALPPSFAHLQYQCDLIKALGAGNETFLVYKPNIEAFDLPKIIPIVLEHESIKFESGKC

SEQ ID NO: 200 - protein, 523 aa, Borrelia afzelii
MEYLQTTSSIKAKFDIVAIVEQYIKLVKSGSTYKGLCPFHAEKTPSFFVNPLQGYFYCFGCKKSGDVIGFLMDMEKINYNDALKILCEKFGVYYDDLKISRESVKKNENKDIVSKIYSLNSRLINTIKFFLNKNKKALDYVLKSRAISKEVVDLFELGYLPLNVKDGLELHGFLVSKGYSSEILKKSGLFSKINPKASILSQRLIFPIKDFKGNVVGFGGRDLDGKGSKYINLSETEVFKKKELLYGFYEGLDEIKSTKSVILVEGYIDVLAFFTSGIKRAVSTLGTSFSKEHLVLIQRYADEIIFSFDGDDAGLSATLKAYQICLPFNINVSVVKMDFGRDPADVLKSEGESSLQEILNNRCDVFDYLLDVYSNKYDLNKTVDLNAMINLFLNLINLSKVDTQKNIFLDKLSNKLGIGVTTLLKDYYRIKERFAVDNNKRNLYAHNDDSYERYLIVALLKNFSYFSIIRRNIIDSDLIDVDARKIFMCFENLFENNEDFSLMDLKRNSKDNYKISEFFLKKS

SEQ ID NO: 201 - protein, 225 aa, Borrelia afzelii
MEKLVFKENTIYSSKFDDIYYNPKYGLEESFYTFIKGCNLDLELKTKKNLLIAELGFGTGLNFICLLKFIKENNITSKINYYSIEKFPLQKKTIMKISKLFVKETVYFKLMLKHYPKIPKKNLKLKITENVNLKILIGNANIKIKEIPKNVEYWFLDGFNPKKNPKMWNNEIFTLISEKSSPGCKLSTFSSARIVKDGLKLANFKYIHIEKGFGNKRHMIKAQKN

SEQ ID NO: 202 - protein, 663 aa, Borrelia afzelii
MKKMLLIFSFFLVFLNGFPLNAREVDKEKLKDFVNMDLEFVNYKGPYDSTNTYEQIVGIGEFLARPLINSNSNSSYYGKYFVNRFIDDQDKKASVDIFSIGSKSELDSILNLRRILTGYLMKSFDYERSSAELIAKAITIYNAVYRGDLDYYKEFYIEASLKSLTKENAGLSRVYSQWAGKTQIFIPLKKNILSGNVESDIDIDSLVTDKVVAALLSENESGVNFARDITDIQGETHKADQDKIDIELDNVHESDSNITETIENLRDQLEKATDEEHKKEIESQVDAKKKQKEELDKKAIDLDKAQQKLDFAEDNLDIQRDTVREKLQENINETNKEKNLPKPGDVSSPKVDKQLQIKESLEDLQEQLKEASDENQKREIEKQIEIKKNDEELLKNKDHKALDLKQELNSKASSKEKIEGEEEDKELDSKKKLEPVSEADKVDKISKSNNNEVSKLSPLDEPSYSDIDSKEGVDNKDVDLQKTKPQVESQPTSLNEDLIDVSIDSSNPVFLEVIDPITNLGTLQLIDLNTGVRLKESAQQGIQRYGIYEREKDLVVIKIDSGKAKLQILDKLENLKVISESNFEINKNSSLYVDSRMILVVVKDDSNAWRLAKFSPKNLDEFILSENKILPFTSFAVRKNFIYLQDELKSLVTLDVNTLKKVK

SEQ ID NO: 203 - protein, 356 aa, Borrelia afzelii
LDLLDLPEKEKQIKIKGVFMTKPKIFSITKEKIKIFLIIVLTSTFLLGIIFSNENKVARILEEKFFDFDLNLISKIETEFEGTLTKLDKDWVLTYNKQNIPVDNKKVNSLIKALDELQKNKLVSRDQKKHKELGIEENPSFKLFDNNNKLLTEIFVGKPGEGDSRLAYIKGSDENVYLTKNIFLSYKGNSYNTFSDTALFQEKNTKLENLSFKMIRKLNKENENNINNDYEITTKDGLYFLNNQKITKERPLNIIAEFKADGLEIDKSKIDDYRLQYKIEVKWSNKSVNNIEVYFNKNEENDKDILIKKDKDEYYYMTSKWTFFDVFNLEKKLIEKDNISSNDNQEDHHEHNNNTD

SEQ ID NO: 204 - protein, 309 aa, Borrelia afzelii
MINVEKVTKMYGSFTALFNVSFKVEEGEVLGILGPNGAGKSTLIKILTSFHYPNKGNVKIFGKDIVEHSKEILQQIGYVPEKLALYPELSVKEYLKFISEIKGVKKFKKEIDKVITIFKLKEVEDKLISQLSKGFKQRVGIAGALINSPKLVILDEPTNGLDPNQIIEFKEFLKELAKESTILFSSHILSEVESICKRIIIVNNGIIVADDTKENIIKNKLKEIEIELIVLKKSENEKKFFNSKNDIFTLMQLEEQEKDLKISLKLSQGKTEEDLFNYIVKNNIILKAMIPKHESLEKIFSKLTKEREK

SEQ ID NO: 205 - protein, 109 aa, Borrelia afzelii
MELNEYQEKAKKTAKYKNKKEELILTTLGLAGETGEVVEKIKKLGRDKNYIIDDEYLISIKKELGDVLWYLSTLSNNLGITLEDVALTNLKKIQKRHENGTINGEGDDR

SEQ ID NO: 206 - protein, 348 aa, Borrelia afzelii
MTILPKIAKDIINAYDQKILPNAILLLGEKFSSKKISAIELAKKILNEKNLTNPNLLIFSNLDTIEAKAHLSADSYKIANKYLEYIKTVIFTKCYFSNEKNLKKIEKNINYINSVYYKKEYNINIKNELIKNIENINKELNHSINVHDVKKIQTWIFSEKEKSKVIYINEIENLSFNVHNSLLKILEEPPSNIYFILAARNKNKIPKTILSRLRIYNFTKPEKKLGIQRFKESFLIDKDITIEEYFASFYKEESKKIKKELTKILNIIKEKKSIFNLEEIDFIKDDQSFKIFLNELSINIRKDFLENKININQYLKYTEHLKNIYRYRPYNQNKKLIIENLMLNYEEI

SEQ ID NO: 207 - protein, 336 aa, Borrelia afzelii
MNKLMLMLITFATSLLAQTNETSTGLKAEQSFNNNLSESVKLTEIADICPTNTIFLTGTGIVVGLHEKGDSLKQKDLISKILEENNTIDEISLNNIESKNIALVNVSLQIKGNTIKGSKHKAYIVSILDSKDLTNGILLKTNLKNNEKEIIAIASGIIKNNNKLKGYGHTSEYTLDSVIINENQNINYGYNIILKKGNYTLINRIHKILTSKKINNKIKSDSTIEIEVKNISLLEEIENIEIETTPKILIDKKNGIILASENAKIGTFTFSIEKNDQNILNNNNKTTIQINSMKLNEFILKNSNNLSNKELIQIIQAAQKINKLNGELILEEVDGN

SEQ ID NO: 208 - protein, 394 aa, Borrelia afzelii
LRKDLIFLVLIVLIIVGVVIFFIRSSKKELVYFELNTKSNISFLFLVEDLNKNLVSMQEIFINIKTGNLGFLDIPIHTGYEDLKGNISWFKDLYKKNSFNKFLSKIYTQLSHESDYYIRFQKENFVRLIDYLGGVRLLVKNPVKVYSFEDSILIPSGTSNFDGDKSYNYLRYFNDVNHFEERGEFFKEFFKKLLFQISDFGIENDIFFKIYSMLDTNLSEVVFKYIVKNYKINNDKIISINIKGQEEIFKDNDNNLIKVVFPYYGGAILKESVDKLNKELINEGSEEVVKIVVLNGTKVVGLAKKTANIFNSLKFKVLKFGNADKNSYKNTLIINNSDNLEMAVRVGEAIKASNIKPISEVQTKRLLELDNLDINPDVIVVLGDDFDGRYVKSK

SEQ ID NO: 209 - protein, 639 aa, Borrelia afzelii
MNGNNNMNNNGKSNNKKKNKNWILGLVVIFLISAIFMSYFIRGGESYKNVPYSTFQSYLDNGLVESVVIIDKNLIQFVVKGSNFAKSYFSTSIPYLDINLLSELKSKKVELSSGKSQASLIGVLLQTLPWILFFIFFFFIFRQTQGGGGKVFTFGKSNAQKYEAGKNKITFKDVAGQEEVKQELREVVEFLKNPKKFEKIGAKIPKGVLLVGSPGTGKTLLAKAVAGEAGVSFFHMSGSDFVEMFVGVGASRVRDLFDNARKNSPCIIFIDELDAVGRSRGAGLGGGHDEREQTLNQLLVEMDGFGTHTNVIVMAATNRPDVLDSALLRPGRFDRQVTVSLPDIKEREAILNIHSSKTKLSKDINLQVIARATPGASGADLANLINEGALIAARNNQDEILMKDMEEARDKILMGVAKKSMTITDRQKLETAYHEAGHALLHYYLEHADPLHKVTIIPRGRALGVAFSLPREDRLSINKHQILDKIKICYGGYASEQINLGVTTAGVQNDLMQATSLAKKMVTEWGMGEEVGPIFLVDDEAPIFLPKEFSKSKAYSENTADKVDREVKRILEECLKEASDILVEHKDQLVKLAKELVLKETLTDKEVRELLGFEASKDEYDLFAVDSTAKEVKGEDTKG

SEQ ID NO: 210 - protein, 1467 aa, Borrelia afzelii
MNLEFLKNKTFLLLILPLLVFVLIIFSINLFVQVQIYSAKFLVVKYLESKFGFKIKYDNISPYFLSSIKIDGLELSLDGKDKILMDVVRVDLNLFKLILGDENIILNVYVKGSNLNFDINDFSLSDDLSSSSAYSDNGNVILNKILNYLYRLNINLENININIKLNKHNSWLNFKVRNFSLSTVDEDFLFSSVVDFSAVKNLEINLPAERVDDGVLDSTFYFEGKFKKGFEDGYINFSFFELKTSYFSLLEQGFQINYSKGNLKIFNLQRENFDFNLSYDKANGFIRLDALFFNVNLLNWIKLNKDFEIYKDYFDISLNGQLAFSYDFKDKDVRYAGIIDSSLNADTIGKEIQGLQLKIKGNDSIVSVENAFLKLKRGVVNYKGYYSLKDLLPIGRLNFKSAKILNFNDLNGYLDFKKDKNIFSVKSDSFSLGNLSFQDLSLKTYFLKDKIFVDYLIYLENKNSQISLKGDLNDEEFSFNLGIKEFPLLFLKEVVPSSYLINFFPKTLFSGKYLNLVSDFNLNKFDYRKNRLKKFNFIVFSKLDNFKFMFDASGEKNFYKSNNFDLQYNDYNLHSSLFVELFESGFNISTNFSYLDKNYPLNFNVNFKNKFIVAESPLGIKLDFNYFDSKIIYTLNVNGFKVYNKTSDLLININFHGNYLELNNDLKFRIDKFNIIKASKIPAYNFNFGFKGLYEYDKLYISDVKFINKLSNLQGYGQFNLKDNFNGSLNLFSSLNSERYFLGVNSDEYGSYFLLKFQDLDFYNFNSLSLLEGKVNGNFLLNFKNNDFKNYSLSGYLEADKLTLLGIPMQFSLNLGLLDNRLNIYDIKVKRNKKEFLTGSLRYDLGSSIGVSNMVFNSDLFSYKFNANFRNFESRDEERFGVLKTKTEGEFSFRDIKYKNEFLSNLTVEFSNDFEKFNMASIDYDLIDVLYHYGNGEYSFILKDYLPLSFNSSGKIIKNKILGNVRDIKFDSKIITKDFLDSHPLFNIDNHFILYDLFLNGEFDIDGDLYNPNINGSLNIQKGLISTEYLRASRKFGGDRTLEIFDMPVEIQDNKIIFSNEFALDRYSKVFVSTSLNLNFLSDTIIDYYKIDINVTGRTGVPIKFDKIALSFTGYALGNFSIEGNADEIMFKGILNISNAWVYSLESSIVNLLVNPFKQAKRAQTVDINVRDFDILTHLEINFDSGVTFHWPDSNISFLQATISRGDKLVIKSDTKTDDFILKGDLNIANGFVNYNNKKFIFKSGAYISFNESRIKFDPWIKAEATNTIKDRNDKLLVTIGIDSPLSLWKIEFMSYPSRSEQEIKYLLSGSTMGGSEGGLRSAGTNAAEMAIGIVSDIALDFLIQPIEDYMRSVLNLDLLSIKTDILKNSINSNFFKIGNPTFVDVLDNTSVKVGKYFVEGVFISGGFGFLKEQTTPFSKDLNFVINLGIEFDSPFFLVNYEFDYNFMKKGLDGIGNNIGISWKFKY

SEQ ID NO: 211 - protein, 177 aa, Borrelia afzelii
VFFLILPLFFLLSFNVFSIDVIKIGIVDFDRIVIEVLNPQLKANLDQIKNRYQEQINGLNLELKNLKQMYDKSIADNDLDNARSFGNQYNLKVDELKRVSSLAKNNLEQQRLANINSLNNNSESLSKILHGIQYVAEINGFSLIMKKNNPYILYHNSTVDITDDVIKYLLEKYNKNP

SEQ ID NO: 212 - protein, 279 aa, Borrelia afzelii
MLKIILKTLTKIIAISCLIVGCTSLPYSPPKQNLNYLMELLPDANLYAHVNLIKNRSIYNSLSPKYKSALGLINDLYFSYKKENNDFALLIMGNFPKDIFWGIHRNRNTESIGNIFASPKWKLKNSNIYITPNRARTSITINQKDKTLKEHNILTTKYIKEIEENEMFFWIQDSKLLLSDQIASSKNLIPFSSGTLSINRLNQNEYIFKSLLQTNNPSILKILSKKLIPTILTSMSNLTISSPVKATIKDQNTVEIEFNIQKSSVENFIAKLASNIQKT

SEQ ID NO: 213 - protein, 312 aa, Borrelia afzelii
MKKNILAKYILILVSLLSCNISAPNELGNKKTEKKGGGGVLGFIEKIQEESIEGVKQHIEKREKQTMQTASVKPVNVNRNFLYYPQEEIKIKEEVLIPSTDEEKRVDKAISDGRLEFDKLVYNENKLKNEFEQLESSFNNVYDKISKLKDAIQTEAHIVERINHIIKTRPEKREYQNRVRQNQSEERALINLFNQLLEKRGDIEELHTQLDSGLSERASAKYFFEQSQKTLKDAITQRVKSEHRSWSRREYGGNLTRKANREIDNALEQLKTSSSKIIKAMEIKERIEQLLQEVKSFLASSRSKICFHEIDL

SEQ ID NO: 214 - protein, 173 aa, Borrelia afzelii
LKKTIIIFAILAFLFNCTNKDNDTTKLNNGAEEDSQTLQSKSDLVDEDRIEFSKTTPLEKLISKLNLNSTEKETLTFLTNLLKEKLLDPNAGSNFKNTGGDESKIEEAIHQFLSDLKEDEIKEMLAKIKENKDKKEENSEELNTYKTILASGFDGIFNKADSKTVLNNLKDAV

SEQ ID NO: 215 - protein, 280 aa, Borrelia afzelii
LKIVIIFVVVLILGCSLDNNSKMENEGGGFKENGLDRLGQEKRALGSSNFRSLLDDSGVGSNFQNYEPLKALENKNKFINYNQIEFLEGTKSVNLYLWSTYIRWVKIKARDLCDERGNCIKELNGIKYSYLVSPIDGSYISYAMPLIIFETTSESDPFYSVSGFKLINKGSDINFNDNKGGFLGRIPMSEKSVESGLVTAYPFGSSDSKRVVEAFTALYNNGIWNDMIAEITIKSKNPPQNEKVYRISLDSKLFNVTMKKIIEKYPNIKNTSLTFNSLIN

SEQ ID NO: 216 - protein, 181 aa, Borrelia afzelii
VDIKINKRNLSESVREEEQALIHYNKLKEKLNINFQKEIYCKLEAMKVLKEIKDKEYYRLDNYSNFDDFAKDYRLARTQTYKYLKIATAIEEGLIEEKYVVKNGINETICLLKTKESPSLKKSTQNPIKPLRFQLKKEESYSFYKKNAKLTSFLLEKIFFEEKDFLLKIINEFESSRNKRK

SEQ ID NO: 217 - protein, 169 aa, Borrelia afzelii
MIKYNKIILTLTLLASLLAACSLTGKARLESSVKDITNEIDKAIQAAKDAGVNTDAFTETQTGGKVAGSQIRDAKKLVADLTIEFLKATEEETITFKENGAGEDEFLGIYDLIYRTAEAVEKIGMKDMKHTVTQEAEKTPKTTADGIIAIVKVMKAKVENIRKKQTKDK

SEQ ID NO: 218 - protein, 528 aa, Borrelia afzelii
MNKKKIPLLTLLIIFVNSCTISKTKDDFIFGVGIGNEPTTLDPQFCSDKFGTLIINELFIGLLRGDPKTGGYRPGLAKNWEISHDNTCYIFHLRDDIYWSDGVKITADTIKSSYIMALETEESLPNISLLTSKIKNAKEFYETKLNPDEVGIKVINEKTLEITLSQPTTYFLDILTNPIFIPVPIHIIKKFGNKWTSPENMVTSGPFKLKRRILNEEISLEKNKKFYDAANVAISELTFVTINDARRIYSMYEHNEIDAIFNNIPLSLINELILREDFYSTDINQIGFLSLNTNVKPLNNPKVREALSLAIDRETLVYRVLDNNFKATRKMVPNINNYNYGKKLKLYNPRKAEKLLAEAGYPDGKKFPTLTIKYNKNDLRKEIANFIQSQWKKVLNIDIETEPETWNNYVSNILKGQYEISIRSWQGDYLDPMAFFNMFETENTHFSSYGYSNPELNELISKSKFEVDEKIRLELFKKAEEIIIENDYPVIPIYSAAGNYLFRNDKWTGWNTNNSERFALSEIKPLED

SEQ ID NO: 219 - protein, 216 aa, Borrelia afzelii
MKGISILSLLLLAFSCKQYGSVKALTEIASDSGDNNSLVVSDNLSAKEPIAEKGPTLTSQESERLEALKTFLKDAMGVNGREDNLKAEYEKSYKEFFDWLSKDVNKQKEFVSCFNNICGIVTKAVDADKQRRHDQKSLGFNEYVCHKIKNSTGGALSLFFQKVADAFGAEEYKKKDDESSQKPEKCNEEIFKVIKRVFTESDSNNELKNLKNHGNI

SEQ ID NO: 220 - protein, 399 aa, Borrelia afzelii
LKDKLIKILNKFLMLAPLLIISCNANMNTNDKNKALNEYKLQNISEVIKNSLQIESDFKKELEANINKSTPPILEIEKIELGKQEFPLKSESNSEILIPLEDTNIAKSEEEIAKIQEKLLLIGAPDEIAEQELDPNKKPLHLTTIEFKISSNAEEQEILNPIEEETNINIKDKIFDQKEENSTLNESTKTSTQIQFQKQSTYLSEDGNFITKEYAEQVRESLDKTLNAIKNLETSKDLEIENEIENLSKEQSSANTSNNTSANNINTENIEKTKNKLLEKLKKSELIFEETKDPLGTSTIKQVLDAANKWQEQENSSQINWDLGSKFHPNPKLYNKSVAQEYKVLAEKFTKVKNEYKNTKDQLEVHSKLTTSNISKIIDATKEFTSQVRNLISLVENAH

SEQ ID NO: 221 - protein, 293 aa, Borrelia afzelii
LKKNTVYKILKLFTITLLFSCSFYSKSNNTEAISELQQNSIEIKNSGIGKTENLKNIQNLQQNQLLNNEKEMVIKNFTQRLNENEKLIQKIGPNISIFAPKINKDVLKIEPIDQFRINKNTFPENTQSHILNLTLKDNQIRRLFYSSLDYNENKIKKLISILEQASSSTGYHYNVIGLIFWTGFKTQESFEKAVNLLTKNEQRRLMFNFDTKTVKDIQEKFEKLMQNRNDWIKTVEKIIDEYDNNIANVKADGMILGEMLRLEYEHKLNPDESMRIANDIETLLKACCDHTHY

SEQ ID NO: 222 - protein, 365 aa, Borrelia afzelii
MKEIGISIYPNVSPKNKIIEYLEKSAHFGFTQVFTSLLYINGNEFDVFKELLNIANKNGMKPIIDVSPNIFKELEIDLSNLRNCTKLDYFKKLGAWAIRLDNTFTGIEESLMTFNDSDLKIQLNISNINKHINTIMYFKPNIKNLLGCHNFYPHKYTGLSRTFFKETTKIFKHYSIPTAAFISSNNAEECARGKEKEGVPTLESHRSKDIETQAKDLFKEGIDTVLISNCFPSETELEKVSKVNRNVLELKADLNPKATPVEKEIILENLHFNRGDINSYRIRSTMPRVYYNNKKFPVHSPNEIKKGDILIDSSKYLGYAGELQISLKDTPNNGLTNVVGKIVSEELYLLEKIEPWEKFKIIENK

SEQ ID NO: 223 - protein, 530 aa, Borrelia afzelii
MKVLIKKLKAVLFFNVILFISCVKENDGHKLVFKLNIGSEPATLDAQLINDTVGSKIVSQMFLGILDGDPRTGGYRPGLAKSWDLSNEGLVYTFHLRDNLVWSDGVAITAEGIRKSYLRILDKETSSSLVNIIKSTIKNAEEYFDGKVNESDLGIKALDEKTLEITLKSPKPYFLDMLVHQTFVPVPVHVIEKHGQEWTNPENMVVSGPFKLKSRVLNEKIILEKNNKYYKSKDVVLDNIIFFITDNSITAYNMYLNDELDAIFNNIPPDLLKDLKLRDDYYSIGTNSTYFYSLNTKVKPLDNVEVRKALSLAIDRKTLTESVLNDSSIPTRRATPDYIDYSYKSNLSLFDVEMAKKLLVDAGYPNGKNFPLLKVKYNTSDRQRKIAEFIQNQWKKNLNINVQLENEEWSTYINSRVNGNYEIIRAGWSGDYADPMTFLSIFKTENTAFSSYGYSNSEYDKLLIKSDHESNIFERQEILKKAEAIIIERDFPGIFINIISSSYLFRNDRWKGWEPNISERFNLSEIKPIK

SEQ ID NO: 224 - protein, 403 aa, Borrelia afzelii
MTNKIIKEALTFDDVSLIPRKSSILPSEVSLKTQLTKNISLNIPFLSSAMDTVTESQMAIAIAKEGGIGIIHKNMSIETQKKEIEKVKTYKAQKTINTNKVTNEQETKMLTKQYLEEPEIHKNTEHKEDFSNACKDLNSKLRVGAAISIDIDTIERVEELVKAHVDLIVIDSAHGHSTRIIELVKTIKNKYPNLDLIAGNIVTKEAALDLINAGADCLKVGIGPGSICTTRIVAGVGVPQITAICDVYEVCKNTNICIIADGGIRFSGDVVKAIAAGADSVMIGNLFAGAKESPSEEIIYNGKKFKSYVGMGSISAMKRGSKSRYFQLENNEPKKLVPEGIEGMVPYSGELKDILNQLKGGLMSGMGYLGAITISDLKINSKFVKISHSSLKESHPHDVFKMP

SEQ ID NO: 225 - protein, 212 aa, Borrelia afzelii
MKKNTLSAILMTLFLFISCNNSGKGGDSASTNPADESAKGPNLTEISKKITDSNAFVLAVKEVETLVSSIDELATKAIGKKIQQNNGLGANADKNGSLLAGAYAISTLITEKLKALKNSGELKAKIEDAKKCSEDFTKKLAAGHAQLGIDGATDNDSKEAILKTNGTKTKGAEELVKLSESVASLSKAAQEASANSVKELTSPVVAETPKKP

SEQ ID NO: 226 - protein, 364 aa, Borrelia afzelii
MKDFLTNTKSPNCYNKHQHKLIVLISTLKYVNKKYKKYTQQNILYYFNENLKRNGQNPVKLKTLQKYLYELEKKFKVTTNYYKHLGINCGTEIYYKLNYPKKECHYMINKYFKDKKHSRFEKRAEIGLKDKFNKNRCVNLEECLSNKNNNIKEEKNKQIEKFQIIKYSNKCNFKCKEILPFILYLDINKDLKIKMLKVSKIIEIKLLKHKNIHFNKSCFKDKQNKLKEILKNTKKQLEKKGYNPEQLETEFKKIYENYKLKPHFIIEYQKYDDLSKIKRKLEKSIELKKENPQKDYEHIKTNIFNILIEQLKEKANIEFIKPIIKTYLNSKKKLEYNKVFDIYNCELLELIKNENNSLMLKEVV

SEQ ID NO: 227 - protein, 1081 aa, Borrelia afzelii
MKLDEIIIPLSMSISNNQKLDSIAETLKKIAEQKFASLDNLKSKLEKSTASGSNLEKALNKSSQNASKNFKSLANSVDSVNSKASGMKSIGKVLKSVGKGLGSVKNLANKTGEAFNQMLAAFAPIIIAVKALQAIGSTISGIFDGAMDALDEFNEEVSTFSDMLGNEELGKSLAESMRAFGDETLFTRDAIANATKTMLSYGATASEVEERIRMFGEAAGGSSEGLEKLAEVYSRVESSNQVNLEDLYALRDAGVDITDILAEEAGLAGEALYKAASDGQIGFEALNKALSKATSEGGKFYGNTAKEAKTLSQAQQQTAKMSEKLFLDIGKALEPMMIGFEKVKQFLLVAIMVPLTKVTTATIYLTTKLGELVVYLSGKWLEGVKMWFKAISTPFVKLFEGIKYVFNKLKELAKYVSSVFPERFKSAFEPIIKWFQKLLDMASKAYEKFKNIITFWKKSKKEEDTPSSEPERDKKVDPNAKTDYNKKIEQDYKKLQDEIFFAQREIYSKVGVEREKALRELEKTIKKKNQKFLNTYSKRFDELSDENKKILVGVEKAVNEFNNSNYDFVNEYQELLKEKESRERKILLTLPHTDQESALQKLNDEINGKNKAFVEKYGKSFETLNESNRKIVAELEKKVKEFEKAALDRSFVEAQKALQKNILALEWETMLLPAKERASAEKKMASDIQAMYKKFVDEHKSQFDNLNETNRNALKQMAEKAKDTAKSLYDKCLENLDKFTEFTGKILNQEVGEKAGSEGFDYAADSATKGLVDFGKNTLKAVGASFGPVGQAIAEIVIQIGEFLWGWFKGAEKARIKKIEEQRDKDLEELEKRSEIELKKLEEKFDAEIAMRKEKLSELDDEYSKEIEFLKQAQSKGQISGEEFQKRLHDVQTEYKTKKGIETTKLTKVEETKKLEVERQNKFSKLETERIKAQAEVDKVNTRMWSWSKSSDLEKAQKILDEILKRIATVKSAGSIEEIKLARGGARFVSNKPTYMPNSGVMSSEFGQPELVRITPAPIDENLRKLEAKIIAEEIAKLQKSQSSTVVNNFYYNFNGDVLDAEKLVRMLKSKEHLMTFRMAE

SEQ ID NO: 228 - protein, 142 aa, Borrelia afzelii
MVINVNLTGKVMLPYIPDYIRNSKEKIKEEEKAYVVLKDINYGFVEKLKARQIELFKKLNGENGKTNSNAMIESTSAQIQFVKKIWDENVVEFVGLENQQGEVITKEMVESDGILFQDMLSSLAIEINFLADTLRVERVSKK

SEQ ID NO: 229 - protein, 396 aa, Borrelia afzelii
MRLRRLPIYVNAYKEKPNAEIFIYYSSRGTGKTYDIATVNLERKFSVDGGDTLAIRKKKNKTTQSIHKEILELLSIYGLRKFFNISKAKIESKSLIFGKKRAFVFEGGHDTRDLKSYAHFKDLWLEEANQFSSDDIEMLIPTMREQGGRIYMSSNPVPKSHWLYKRYLANQDNPAVCIIKSTYRDNPFLNGGDVEAWLEKQKLAYHGNDIGFRIEVLGEEFDFGTARLIKKFNVCEPSLISRANGSYYTGVHIKGNRICFLEILVGRISYLPVVIVTNACSKVLLSKADYQAEINNFKGTFVLPAAREELKYVFSRFGRGTLLAKKRNLYSLSDYLIPANLSVVNIPETNDVISEFNETEYYYDESSAEDSEVTNFVMQKDLTYIPAFLNAASIFN

SEQ ID NO: 230 - protein, 260 aa, Borrelia afzelii
MISDEDFEEIKKRLQADNIKFQFGVGTMEEAKNYVGKLGEPIVVKDKELFAICNGQNTTNRKYYSLNKNTKPPIGENLEDYLEHLVNWCLENTYPGFLTAEFAKEGTLSRSKLVKAFEDTKKFCIPDGRSLPESCFVKEKFGISSAPNLSGRFLRHYDSGGYTDSDGSRSLGGTQEHSLEKHSHPIDISDLKKLKGRLINDYYYIRRDSNWSSGSTSFLTGIVYGDGIYYWNYPFKTEDMGGNETRPKNTCYISFYRYDW

SEQ ID NO: 231 - protein, 874 aa, Borrelia afzelii
LEEQDNTVQGIDLESPEITGQNPEISSAKEDTTQDCTSLGFDIVFYTDEGQIFELTPFVDISSIVLEEKIVDPSLKTASSNFSFSVSGLSEDFLNFLFFRNEDIFVKVSDNKNPVFTGILEKFFSRDLFNSTKSVSFTVNDYSSLLKIAFENPVQFPINFSPDWLFVYNPLAKELSLVHLIIGKTKLKDLIDDDASEAILDKVPAVIIDCGENVETILQALLYEFGYAYTFSPIGKLKILPIWKSEVINREIEICTIDAESYVMSKSSSSSYDSTKVIWREGKFQSKEESISKKRPLYSAPINVAGNDGKLYVAVLQKGVVYPDFADKVGSSVFQEYDPSWLDTVYKWDFKRREVWHDHYAINEHLAIISTHNLEARFSADSSIKLENKEYFPTKAKLWFRNTSSSQGSKYIYHFDIYGDVFYTIAQNVIQTDNADDFYSKKFEYTTRFIFSEESAVRLFEFLTNLRVKGHTIVNFRSMQNLNITDFVKLRPDNIGIDHFFLILSKKITNFDLDIKLYEYEGITWGDYTHYEYLTTSTKISVSDYLSGVNKVVIAPFNYNGAETFQFKADGFKDEDTLNTAIEFAKQAGLNKIKLLNGDFYIYDQVNLNNLEIQGKDEVTIRSTGFSKHIFTSEKSFKLSGISICQQPLSELYINGGTLNQEELSMYLEDKSFTHPHGVVFCSSYSVKENARSSVYVTDVNFVYIKDVTFRCALNNALYLKKVKKILLEDVDFDSANQGFEISDAKNITLVNTNIKSSKKESVASGYNIMIRESSFENNNNALKLSNFSSVKILDSQLSKNKGTALHLVDITIARLNNNVFVENKVGLENHSFDLIIQDTFLKNTLALDLSDSKGRIIDSSTYSENTKDKQGAA

SEQ ID NO: 232 - protein, 137 aa, Borrelia afzelii
LALGGKMKIRMKHLVRRLYLRRDKIWHVYMSTEIQNKAKDKSITNFPNLKPEDLDYEYVYKFLDEWIQKKYNANKLGFTIEKVDGLEYICKAKRYASLKKILTKIFKDYKDIFLGRLQKAPGVAAVPGSTGKGQGGS

SEQ ID NO: 233 - protein, 200 aa, Borrelia afzelii
MKVALTTNTTEEQIYKEFLRLGMEQLIAQDLSKRYYHNVLTYRDLENLEKQFGIKFDNLISEISFVEKNLDTKIDGIKNELNAKIDGLSIKVDNLDAKIDTVEKNLQKDMSNLAQDLRKDMSNLAQDLRKDMSNLAQDLRKDMSNLAQDLRKDIQINSKLLSEKLKVSNRIIILITVLVVPIAISSMANIVMSIIDSYLK

SEQ ID NO: 234 - protein, 1278 aa, Borrelia afzelii
MKTNNIVKTNDLNISLYKELSEDFIKKENINKLKDFFILIKNKLSSIDDNSTEANIEALLRSIFEKLNYSVEQQKGGQIEGVDSRVDILLFENDKDKVDFNNKLEEAKKNNEPIPAEDILLIVEVKRPSFSFNTKDKVKEAEDQLYRYLNQYQKHYGMLSNGKVWRLYDKSKVLYGEKRYIEFDFSKVEEKEEYKEQEWFVLFIYLIRKERYLKTSNVIEIEKEQISKEKEIIQKTLREILYEKPDDSVIFKIAKNIYDKEFKVSDKEITQHILASILEESIIFILRIFFIAYIEDNEIFKKILEENKLYRSSISFRYFFYDENTKNKLGYKKIITIFNLLDKGSDAIKFPIFNGGLFAEDKVKYLNNESLLSISELEEILVKILFFEEKNIKDEKFVEYSKLDPKSFGELYETLLEYDLRIADTTVHRIVEDGVYLIRTEEELENKQVNKVATYYKGNIYLTSRSLDRKKSGAYYTPDDLTDFMVISSIEEQLKTKSPLDIKIIDNSCGSGHFLISCLDYLTEKVWYELDKFEDVKKELDKEYRAILKESEEYDVQDSISKELVLKRMLLKKCIYGVDINPISVEITMLSLWINTFIFGTPLSFIEHHIKVGNALLGYTKDEFFDITKKKFESGFSLFKERIKEITTILEDSYQKIKSINDTTKEDIEKSKKIYKEYEESEDTDYLRIIFSLIKLYSLSFDKSLKIEFSDITAVISLIENILGNKTSSEDKEKIEKIRKVSSYYKFFHYGIEFPDIEEGFDIVIGNPPWEKTKFNESEFFSKHIPNYRKLSIKDQNKIKQEILSKDTHPLKIEYNEEKNSISTINNIYKSDFKDFTSGGDPNLFRYFIRFNLKLIKPGGNLTYLTPSALWSESSSRLLRKHIFTNYKLNYIYQFQNQKRFKDVVSLFKFVIFQLSNTKFSTSIFKAKFMIQSSDNILKAITRDLKDNKDDPYKGIELNIDQIKKLSPIQESIIEFKDNEEFSLINKMFSQFGVFSEEYIDFQKGVDPSINNRKSLLKEYNDENFIFLYSGANIHQFNSRFFICDDAKERAKLLWIDKEDLKKILTKDNQCQTERVFYRDIARNTDVRTMISTLSPKNCYCVNSMYINYEKTPISIYKKLFIISIFNSLAFDFLIRRFVNIHVQKSYLYQCPMPQPEEKEILSNSLYLNLAKNTSLLVAKNDPGNFKYLLYLEHFKFSKEEVDKILNLDTKDEFFKEKENENNFIVASLYSLTKEDFMVLLNDFEVLKNKKGEDYILSLIKGYENYLRINKLNSTIQS

SEQ ID NO: 235 - protein, 258 aa, Borrelia afzelii
LKKNKLNIVKLNIITAILTSICISCAPLDNVNPNKLKSHTNPRKLKKTKSHTNSKNLAENNQNLKNESQNPKYSNQNSQEKILLSKLEKIDKDLKDQKKQEDIQIANIDAQDDFLETFKLQQDEVFMHITKMILKRIIYSSLNYEKEKILLLKEILEKLDNNAQNRKIARTFLETSRDIQLLIEKIHSINIEDISKKEAEKLLENRERSLKAKQNFAKTLSATIDAYSKDFNNLKTNLKNLATHIKDKYYHISLYLTE

SEQ ID NO: 236 - protein, 352 aa, Borrelia afzelii
MKIKSKCLALGLLFGFISCDLFIRDEIKEKSLGLCDEESSILETGDKSVKKSLNKKGKDKVARKKVEGNAVKKDPFNHHVKRESVNNSNLSQKNVISEEEILKTKLLRERPETRKEEIQKQQDEHKRMLQGSLSFLSGESGELKDTIESNEIDFTIDSDLRLKSDLQAISGSNSISYTDEIEEEDYDQYSLEEDYYYDEETRLSNRYESYLEGVKYNVSSAIKTIVKIYDNYTLLSTKQTQMYSTRLDNLAKAKAREEVKKFTKEELEKDLKTLLNYIRVSARTATNFVYAREIYSKRKLDAIETEIKNLILKIKGQSDLYEAYKAIVRSILLMKDSLKIIEIVIDKNGVWY

SEQ ID NO: 237 - protein, 319 aa, Borrelia afzelii
MELFDENYYAKAVANIIGEVKDPIMYKWFLPDQIEDVDLQMGYQRTVKWDAFLNANPTTIANEVNTISTIGFSSEVVRLNYLKLQYKFRHLKQASEKFYTSDSYIGDINNNLLPFAQAYKLASSEIIKLINHFVLTGAVSIQKDGKNQKRLLPNMYGLLNMPHQIKEEVASGDKDKMDKIFEKIEAGLSKLELGDEFSTPMMVIVDPATSLKLVKPYSAAQGAAMSCEKWEDILIQTIKAINNREDVYIETSNLLKHQILVYPLNPALIKFKPSKYMLPTPNEQVDKDSTDIAHSYIDFVLGGLLATKNTILQVNIKQS

SEQ ID NO: 238 - protein, 144 aa, Borrelia afzelii
MKPALPNIASITEEQIYNEFIRLGMEQLIAQDLSKRYYHNELTYRDLENLEKQFGLKFDNLIYKIDTVEKTLQKDISNLNDKIDFVEKNLKQNLDEKLKIHEKFLLEKLNISNRLIIIITIIIAPIAISSIANIITSIITGFSK

SEQ ID NO: 239 - protein, 185 aa, Borrelia afzelii
MSDITKIKEEFDKKVAEIKALMKNPQQDSGLLSNSLEFRDKNLIYSNSGGVWTSSKDKIENYSVKGYPYKRGVKLSFSIDGTSELEVEAGGGDDLYGICTDIDEFSGMATVMPITNNFTGYLTFKKPGNDIKPGDKLHFNQHGELEKTTGTEKSINAIALSKVHKLTEELFIGLASVFGNRALKG

SEQ ID NO: 240 - protein, 353 aa, Borrelia afzelii
MGDKFTIKFKGVLDHAVTKKAIEQDITKMEKYLKPKKSSLGSTKDIVKNNLSDKKKELSKQSKFENLRERVEKYRLTQTKKLMKQGMGFEKARKEAFKRSLMSDRDKRRLEYKELAKESKARNKMIAASQGKGLVAKIAIGSALGNVIGNAMSKVGGGLLGFAKKAVEEKSKTNRTKLLNSAFFEKDERNAIVGIKGKGGILSGMKGFERDLEKEEFLNQASVFKGTLRDLGMLNLNNLKKAVEFSAALKSSGAMSGEDAVKAVNSLLSGEGDELFDLLKKSGVGDKYIEDAKKAWQSGAEVDLESRITMLVEMFKDFKSFGLTKKADTKEEIDSNLASAEQTLSNLTTTVLD

SEQ ID NO: 241 - protein, 370 aa, Borrelia afzelii
MNKKMRMFIICIFFTLIISCKNYASSEDLKNLEQNVKGKVKGFLDTKERIVSDDPTVYEIAEKLKEEELKGKKESKQEQEDKEELMQGDDPANIDLPSILQTNNQDSTPALEAAQQITSGGQQKEEEKGKEEKEQAKAEEVKVKEEQKGEQAKAKAEQEKKEKEERERKEKEKQQQEQQKKRQEEEKKKQEEQEKAKAEKERREKEERQRQEQEERQIKSKIETLTKKIDEINRDIDSIKYKSWFVENEKRLEVKATEVRDKVTGPIYDHFTNDANTAIYYTWNLEDEEDLELGKLLEKLSNTRNSLRTKLNENNATYTLEEPKLKENVKIEEIESDLDELKSELEKVKEYLKNESNFKEIKEYISSSDD

SEQ ID NO: 242 - protein, 185 aa, Borrelia afzelii
MNNLAYRTYNIESIKNEFLNIGFSEEAIDFVFLHNDNYSFEYLKEKIIDIEKTLRKDISNLDTKIDTVEKNLDTKIDTVEKNLQKDISNLDTKIDFVEKNLQKDLFILNTKIDNVKGEITNKIENEVKNLQKDISNLDTKIDNEVKNLRKDLNMGNRLIHFMILTAAILGPILNALFMKYLQFIK

SEQ ID NO: 243 - protein, 236 aa, Borrelia afzelii
MNKKMKMFIICAVFALLSSCKNYAISKDLESLEQSEQELKSPKQIEQEIKKEFNGLLNILEKKDISNLDEKDTKEIEKTIKDLKDQIEKTDAKKTSLKTYSEYEKTVKEIREKLKDKLKDKKELEDKLKELEDSLKKKKEERKKALGEAKKKFEGYKGQVGSTSGVTQGQQTGNQGKVGQQAFKDVKELGLSVSSSSKNGADTGDMSKGIIDDALKQINEELKNNGEEAVEEKKIK

SEQ ID NO: 244 - protein, 154 aa, Borrelia afzelii
MKIINVLFCLFLLILNSCNANDNDTLKNKNKLTESQQAENGEKHNSGQIELQQEIPKSPEELLKEKLSEDQKIHLDWLKTALTNAGEFDKFLQYDVSKIKTALDHIKTELNKCKGKQNAAQQENTFKQTVQGALSGGDIDKFPEQANSLCDILP

SEQ ID NO: 245 - protein, 189 aa, Borrelia afzelii
MKTLVGACIVTLAVLGCYLPDKQKQAVQTFFKNSQSSDIGSDEIVADEIVADGIFDNLKLYMTEHNLLVDIKKTIISLKDPNYRAVPPVRDYNEEYFNKFFLDLGSERSKELIKLFGKIKNEQNDDKFKREAYWLYSCIRDLYSSDIKYSGENGNEYIVDMPRRPTIDQQYLKVKGSNRTVCFKMIIVY

SEQ ID NO: 246 - protein, 111 aa, Borrelia afzelii
MQNNTIGLGLNLLSSLTNIAKTDTNIDHNYINTFSKVIDFFYKTYMNTLKSMETAESTKILEEIQDILKYNIEIIEAISNNKSNKIISSLKAKRNKIMREYINILKRGENA

SEQ ID NO: 247 - protein, 176 aa, Borrelia afzelii
MELVSTKNITEEQIYKEFLRLGMEQLIAQDLSKRYYHNKLTYRDLENLEKQFGLKFENLEFKIDTIEKNLNTKIDTVKSELNTKIDTVEKNLQKDIANLDAKIDNVEKNLKQNLDEKLKINNQFLLEKIEINNQLLSKNLDSSNRLITIMSIVLVPIAIAIIGPFVLSLINGFFKQ

SEQ ID NO: 248 - protein, 157 aa, Borrelia afzelii
MSNLAYNTLKIENIRLEFLNKGFSEETIDFILLQNDNYNFEVLKERMNSLEQQIINVENNFQKDIYSLDVKIDSVKNELNAKIDSVNAKIDNVKNELNAKIDSVNTKIDGVEKTLQKDISSLKNELNASNRTIQVMLIAGITLAPIIYSIFNKYFFN

SEQ ID NO: 249 - protein, 186 aa, Borrelia afzelii
LMSIKNKMIITKRVEIKENISKMESLEEIHKEEYLRLKDKLKTLTTDDIYNKIETAKILNTINQKKLYILDGYKNFYSFLAGFKIAKSQAYKYIKIVSGVEKGIIDYNFIASNGIEKTIKQLESSNIIKKSNQNPIKPLRFQLKRQDSYDFYKSNAKFTGFLLDKLFSDEKEMIKKIMKEYKALKG

SEQ ID NO: 250 - protein, 180 aa, Borrelia afzelii
LDIKVNKRDLSDNGNYIVADSALNHYNSLKEKLKINSKKEIYCKLETLKILKEIKDNEYYKLDGYKSFEAFSKDYRLARAQVYNYLKIANAIEDGIIQEEFLIKNGILETLIILRNKESKTIKKSKQNPIKPLRFQLKKQESYDFYKNHAKFTAFILEELLENQKDFLNKLLKKYKQLKG

SEQ ID NO: 251 - protein, 146 aa, Borrelia afzelii
MKNRFFFIYLSSSFVFLFSCNGFLTLESKERSSFTDKQRISILETIKNHYNGDSEKIARVDKYFDRLEDSQKDVFLQLFSAGFDYINSKESEPKESEPKESANRRANLDALKSNFESKLKQLNYTEEDFNKLVDDFNEFVDPKPTS

SEQ ID NO: 252 - protein, 130 aa, Borrelia afzelii
MEIGEKIRKSIFDNAKTFVGFKVKKNMEQLKSSVPGRLSNVTKIDLEETSLGIDLKVKVDSPLAEFLDSGKAYGNNSSSPSLAKIRNWAAYRGIESAVVPIWLSLKKRKPKTQYTNWTSDLVKESAKLLR

SEQ ID NO: 253 - protein, 358 aa, Borrelia afzelii
MVKKVVISSTSIMLSIFSLSCDLRKENAGNKIGSVISSGKDYWDNLGCKYLSGSEKSIFNAFPKSKKSQVFYSILKKENGKDAIQLLINWGIDFQTASSIAISIDKELVELKNSQIKLSDNDSYEVGNAGNYNLPYSSIDSDNNLLSADSSFYSNLDSNDNANTNYLNSQNYTYQEYTNKQAQEMQEIFKKYKIFKENAYKLSQTLNKSTSYAEELNTKLSEINTKENNKFILKADDIKDIIRLIARIKMTQYTDLSKKILDNNFSNIASDEESARYVLLYKNTNSPYLEVRKILGSILSKISSIVGGSKANVVDIEDSEKIKKAKEYAQGVLDILKSIDSGEAVEAVLNKAKQLEKK

SEQ ID NO: 254 - protein, 161 aa, Borrelia afzelii
MRILVGVCIIILALLGCYLPDKQEQAVQAFFDENSPQSSDMGSNEIVTEGIFANLKLYVAEHRLLIDIKETLISLKDPNYRNVPPVGKGYNEENFNKFFLDLGSERSKEFIKLFGRIKNDRNLFEKKVSLLFYCIEDNSSNGIDFRSINAIFDEEEKGVIK

SEQ ID NO: 255 - protein, 207 aa, Borrelia afzelii
LCYIKKYLIFILLLNLINCNLSNKNKNSDQDDAIISSLDSNQKQAFIFFKDLVKNKQYSKDFDQAVEGEEGPLESLKAQIEELKKKNEQYIELQNKLDQGFNCDYDDSKMKKLFDELGNDNVKKFLQQLHLVLKAINDGTHISFTSSNLTQTTKTLSEKQEIVLDVTKRNLYVQFYFYSNNLYREGYTSAGYFFNEVMEYHLAMDNY

SEQ ID NO: 256 - protein, 114 aa, Borrelia afzelii
MLETKVNENDVYNELVRLGMNKILASDLATRFYHNEITIKDLEIVKLELQGFVRDEVGTVKDEINIVKGKIKSLKTEFDSKLKLHNWMIGIVLASQGTIAGILVSLFFYIVNKL

SEQ ID NO: 257 - protein, 169 aa, Borrelia afzelii
MKKISLLIFLFLFVVSLSANIEENYTETKRAFSKEDFNLINKRLDNYDFKNEYEKSHVFSDAPRIRGDLRKIGIKEKSVFLDALEAIEYLIKIKISTDSIFLSEDMIRLIGSYPDSIFNYLIQLNSDKIDYAEKYGDNARNNFKKDYSEDKANTVKQILKQILADLPKD

SEQ ID NO: 258 - protein, 42 aa, Borrelia afzelii
AIKRPTIPQSHPQKNKKHKSKNGEISSLFPCIFGSRIFPINI

SEQ ID NO: 259 - protein, 28 aa, Borrelia afzelii
SRFCCYLSSIWSRLFSPFKTHPTSTCPS

SEQ ID NO: 260 - protein, 46 aa, Borrelia afzelii
NLGVIAMTKEKFSFAVPSERFITLKRFMSNKSSNPTETKSSNLAPN

SEQ ID NO: 261 - protein, 145 aa, Borrelia afzelii
LEIIGVSDIKDILSPNAPALKIAPATNGREMFTLSASSKAIGATATIVPIKLPVEKDKKRVIKKMPHTSKFNGTYLRPIFTTASTLPISLQTAEKAPDNINIKDIKITSCCAHPSINLFIFAKKDPLKKINVKTIAINIANMGGI

SEQ ID NO: 262 - protein, 85 aa, Borrelia afzelii
GSKILPTLLTRPYFLARYPSIKSVNSLKMIKNQIIPKNKYEKNIFSKKNKINMIKESIILANVILLGVIILIKLFNLSNLLISYF

SEQ ID NO: 263 - protein, 86 aa, Borrelia afzelii
RNCDLFANQRLISLIIGINSNSSIPKHCLRPSCCNLNKRRIINKILNKIKLAINLFIFNLFITNNTPRSRIKINKIFTPINQPFRI

SEQ ID NO: 264 - protein, 73 aa, Borrelia afzelii
GLLIFPSIAYPSILSLFSSKLFGTSNAFKDMFERLGSFTCQDCLELANRGKNFTSVSSFFTSSNELLQGIVAA

SEQ ID NO: 265 - protein, 89 aa, Borrelia afzelii
DFNKDSNSSLKILIPSRLKNSGVSGVITSHIARIILRSQSSKLGDKSKIANSNPNFSNSKQKSSIKYGKSCNSCCTSLLKVPLGTHGKI

SEQ ID NO: 266 - protein, 51 aa, Borrelia afzelii
FFILSACFFVAASASLSKLQLFKSEKTHIHKIILFFINILLNWLRLSLLLY

SEQ ID NO: 267 - protein, 63 aa, Borrelia afzelii
ISFSMILRRSSLSILIILRLGNTDSIASCTVFPLKFLFSNFRSKKLLLIANRTSSSTLKSPPG

SEQ ID NO: 268 - protein, 36 aa, Borrelia afzelii
ILAPQYRNIQFSSLHSFSKNLRLFISAVFKPPMKFI

SEQ ID NO: 269 - DNA, 1968 bp, Borrelia burgdorferi sensu stricto
atgaattttaattggtttttaatgttattcctttttaattttagtgttctattaggaagtgatactacagcattaggacattatcaaagggctaatgagtattatttatctaaaaggtattatgatgctattgatgagcttgttgaggctataaaaattaatcccaattattatgaagcttataaatttattgcatcaatttactattcccttaagatatatactcaagcacaatttttcatagagaaagcctctaaaatgtccaatgaagacactgaatataaaattctttatgcaaatatattgttaaaaaacgataaaattgatcaagcaaaaaaaatctattctgaggttttagtcaaacaaaggaataatattgatgctttggttggacttgcttcaatttttgaaaaaaatggattatttatagctgctgctaattattatttatctattcttgattatagtcaaaataattatagtgcttttgagcatcttattgacatttatcaaaggctaggaatgcatgacaagattagacatttgataaataaagtcagggtaaattttttatcttttccagattttcataaaagagtcgctgaattttatattagtattaataatttggggcttgctgaaaagtatgctttaaattatttggctttaattgaaagctcttacaaagattttggagttgttgatgcgtatcgattgcttgcgcttgtttatttgcatgaatttaaatatgaggatgcaatagaagcattgcagaaagctattttagttaataaagattctgatgagctttattatttattggggtattcttacttaagatttggagatattgaaaaggctattttaaatttagagcgagctaaaaatctcaaaaaagatttagaattttataatattgctcttgaggagagtttttttgcatctaattttagaaattttttgaaaaataattccaatgctagaatttctaagcattatgaaaatgaggggcttaaagcttttaaatctttaaatttaaacaaagcattgtttaatgcaaaaaatgctgttgatatttggcctgataatgatagtgctaggtttttgctttcaaaaatatacaagcttatgaatttagatattatggcatatgagcagcttttttatttagcaaaacaaagaaattctactgattctagaattttagatttttacgatgttgtgtcttttgatgttagaaagtctttattttataaatatggatacaaaagcattgctgattttaataagctttacgatgacagagtggtttataaaatggctatttttactcaaagtgagaataagttttttggggcaaatgatttgatattgagatacgctgaaagggtgcttgagcgtaatttaaatatggaaatagttaactataattttgattacaataaaaatagagactatctgattaataatttttctgaagggttttcttattcaagaaataataatttggatttatttttaatttttgattttaaggcagatattttgaaaaatacagctaccttggtagtgaatattttttcaggtaaaacagggattaagcttgtttctttctcttatgatgtgggaggtgttaattatttaagcaatgctttaaattctctttcaaaagattttcatgattatttgcccaaaaaaggaaagattcttcaaattaaaaatgacgatgctcttattaatcttggccaagtaaacggtgttgtaaaaggcgatgtttttttgattcttaaagaaggtgctttaaacagtgatactagagattctggttttattgtttacaaaaaatcagatattttaggcgagattttaattgaggatataagtgattatatttctagaggcattgtaaaatcttctacctttttaaaggattatgttcaagaaggagccactgtgcttataaaaaga

SEQ ID NO: 270 - DNA, 714 bp, Borrelia burgdorferi sensu stricto
atgaatctaatgttaataacttttaatgaatttaaaacaggaatttcactcaatgatactagggcagaacatcttgttaaaatcttaaaattaaaagataacgacaaatttaaatttggtattcttggagaaaaaaacatttaccactgcatttacaaaaaagataaaaaactatttttcaagaaaatctttaaagtaggtgaatctaataaacttaaaaaattatatgtgctaattggaatgataagaccaattgttgccaaaagaatcataaaagaacttgctagcattggaacatacaaaataattttttttaacactgagcttactgaaaaatcatatttaaattctaaaatctttaaaaacaatgattgcgaaaaacatttaatagccggagcaatgcaaggaaaaataacatacttaccaaaaataaaaattataaaaaatttgaaagaaagccttaaatatattcaacaagaaaattttgaaataaaaatattgcttgaaaaaaatagtgaaaaaaatttaattgatatagaacaaataaacaatgcggtcattattgtgggacctgaaagaggatttacagaaaaagaaaaacaattaatagcacaatataatttttccccttacagcatatccacaaacaccctgagaacagaaacagccacaattgctgcatctattattacagcatcaaaactaattaatatg

SEQ ID NO: 271 - DNA, 936 bp, Borrelia burgdorferi sensu stricto
atgaaaatattttttgtaagctcttcttctattgctttagaagttttcaaagagattgtaaagcattatgaagtggtgggagttttgactttgcctgatagacccaagggtagaggacaaaagttaagtcaaaatgtaataaagtcagaggctattgctaggaatattaaagttcttgatcctttgattcttgatgataatgtattaaatttagttagagatttgaatccagatttaatgttagttttttcttatggcaagatttttaaaaaagaatttttagatcttttcccaaagggatgtattaatgttcatccttctcttttacccaaatatagaggcgtttctccgattcaatctgcaattttaaatggtgattgtgttagcggtgttactattcagagtatggctttagaaatggatagtggcaatattttagtgcaaaaaaattttaaaataagatcttatgatacaagtcatgatatttcaaaacttgtatcaagccttagtccaagccttgttctagaagctttggaaaaaattagcaagggttttttgggaattcctcaaaaatcaagcgaagctactttttgttcttttttaaaaaaagaatctggatttatagattttaatttaagtgcatttgagattaaaaataaaattaatgcgtgcaatccttggccacttgtaagagttaggcttgattataacgacattatttttcatcgcgccgattttttggaggtagatttatataaggagagaaaaataggagaaattgttgattttaatcctgaaaaaggattatttgttaataccgggaaagggattcttttgcttttagaagttcaaagacctggaagaaaggttttggattttaagtccttttataatggaagtaggcagctaatagggcaagtgttttcttcaatagaa

SEQ ID NO: 272 - DNA, 1044 bp, Borrelia burgdorferi sensu stricto
atgccgaagacatttggaggaagctttgacaaaaatgaaattcaagctaaaatcgaaaaatatgaaaaagaaataaaccagaaaaatttttggaatgatcctaaaagagctcaaaaagtaattaaggctcaaagtattttaaaaaataaaattgatccgtgggaagagctaataaataaaataaaagacttaagcgatttgtgcgaaattgccgaaaatgaaaaagatactaacggcttggaaattgaatttaatacgcttgaaaaacaatacaaagatttactcacaatttcttactttaaagaagagcttgacgcaaacaatgcttttttaactattcattctggggctgggggcactgaagcatgtgactgggtcgcaatgctttacagaatgtattcaagatacgctgagagaaaaaaatacaaaacagaacttattgatttactcgaagcagaaggtggaataaaatctgttacaatagaaatcaaaggtgagtatgcttatgggctattgaaaagtgaagttggaatacatcgtcttataagaatttctccttttgatgctgctaaaaaaaggcatacctcttttgcatcagtatttgttgaccctgttattgatgacaaaatagaaataacaatcaaaccagaagacataagaattgatacatacagagcatcgggagccggaggacaacacgtcaataaaacatcctctgctgtaagaataactcacattgaaacaggaatagtaactcagtctcaaagcgacagaagccagcacaaaaacaaagacttggcaatgaaagttttaaaatcaagactttatgaatactataagagcaaagaagatgaaaaaaacaaatccaagcaagacacaaaaaaagaaatttcttggggcaaccaaataagatcttacgtatttcaaccttacaatttggtaaaagatcacagaacaaaatttgaaaattcaaacaccacttcggttatggacggaaacatagacaatttcatagaagagtatctaaaatggaaaagcttaaac

SEQ ID NO: 273 - DNA, 1026 bp, Borrelia burgdorferi sensu stricto
atgaaaaaaaaacaattaatacttcttctatttatgccacaaattatttatgcaaaaagctattttgcatctgatgtatttttcaataaataccaaaaattaaatgaaaaaccaaaaacggggttttatattgagtattattctgttgatgatactgaaaaactctacctatacaaagaaaataacttaataaaatacaaaacaattcaaatcatagaaaacacaaaaaaaattacatgttatgatacaaaagatacaaaaagaaaagaagagatttacgataatttaaataacaaaatacaagaaattgaatatgatagcaaaggaaaaactcttgaaacagcaaattacgtttatgaaaacgaaaacttaatatctaaaaatttaaaaacaataaaccaaaaaccaaaattaatatattattctaaagacgacaatggtaaattactaaaaataacaggatcaaatttccaaatttggaactatggaattaatggcgacataaaatctacatattttgacatcaaaaaagcaacaacaaaagttataaaatatgatgataaaaaaagaaattcaaacagtacaataattgttaataataaaataaaatccaaagaaaaaaaccaatatttagatgaagaaaaaatagtaaatacctttgaagaagagaatacaaaaatcatatctacctacaaggcaaacaacctaattaaagaagaaacatataaaaataatgaacttataaaagtaaatgattttcaatacaacgaatctgatatgataatttttcaaaacactaaagaaaaggataaagaccaatacaccaatactaaaattgaatacgaatataacaaagacaatcaattaaaaagcaaaaaaatttatgagaacgatataatttatctaaaaactgaataccacaatgacaatgaatatgaagaagaaatatactacaataaaaaacctgctcttagggtaaaacacaagaacggaaaagtcaccgaagaaaaaccaataggaacaaat

SEQ ID NO: 274 - DNA, 1248 bp, Borrelia burgdorferi sensu stricto
atgatactaaggctaccagaaattacaaaaattgcatatttaattttcaaaaattcaacaaataaaatagctttaataggttctggaatatcattaagtttagtaatgatcccattaattattgtttactacatgtctagcaacatcatgacttctactattaataaatatattgaaagtgaaggattttcaatgcaaatagaatacaacgaaacaaatagaacccattatttaaaagacagattaagcttattgaaaaaaaaacataattataaggatctaaattattttttcgagaaaagaacttatggaattattggaaacaataaaaaacaaggtgtattaataagagcaatagaaaataaattcatattagaaaacaaatcaataaaattaataaaaggtactaaaaacttaaaaaaggattctatactcatttcaaatcaaatcaaaaataaacttaatttaaatcttaatgaaaaaattgatattttgattccaaatacaaaaaatgataaaataatgcccagaataaaaaaatttaatatctcaggaataattgaaaccggattaaaagatattgataataatttggtattgatttcttttgaaaacgaaaatttaatgtcaaaaaaattttcaaaaagtataattggacttaaaacaaattccaattccataaaaaataatgagatcttaaaacagaatttagaaaccgaatttcaagaattccaaataaaaacattctatgaactttactcaaataaatacaataatctggatataagtaaaaaacttttaatattcattatggctttgattataatatttgcaagcatcaatatatcttcgtccctttcaatgcttatttttgaaaataaaaagaaaattgcaatactaaaatcaattggaatgaataatttaaatataaaaataatatttcttttgatatcgctcaccttaagcactatcttttgtggaattggaataataattggaaattatttaacacttaaaatatcttatttaataaactttattgacaatattttaaacttttttttaaaaatatttggagaagaaaattctgaaatattaaactcagaatattacgtatctgaatttcaaatacatttaagcctaagctttagcttaacacttcttggtctttatatgttaataaacattttaactacactgattccgcttaacattgtctcaaatctaaaagaaaaagaaatcttaaga

SEQ ID NO: 275 - DNA, 432 bp, Borrelia burgdorferi sensu stricto
atggatataggtttaataggggttaattcagctttaacaatctcagcaataggttctgcgttgggcatgggggcggcaggtagtgctgctattggagcatggaagagatgctatatgcaaggaaagccagcaccatttttattgatagtttttgtttcagcaccattgactcaaataatatatggatatattttgatgaacacattatatgaggtaatgatgcagacaaatccatggttgttgcttggagctggtattggtggtgggtttgctattgctgtttctggatttgctcaaggtaaagcggcagcaggtgcttgcgatgcattttctgagactgggaaaggatttgccacatatctattagttttaggattaatagaatccgttgctctttttgtaatggtattcttaatgatatttaagtttgtt

SEQ ID NO: 276 - DNA, 1653 bp, Borrelia burgdorferi sensu stricto
atgaatgaagttttatttgtaaagactgctggtaggaatttaaaagcagaagtaattcgtattaggggcaatgaagttgatgcacaggtttttgaattgacaaaagggatatctgttggagacctagttgaatttacagacaaacttttaacagttgaactcggaccagggcttttaactcaagtatatgatgggcttcaaaatcctttgcctgaattggctattcaatgtggattttttttagaaaggggagtatatttaaggcccttgaataaagataaaaagtggaattttaaaaaaacctccaaagttggagatatcgttattgcaggagattttttaggttttgtaattgagggaactgttcaccatcaaataatgattccattttataaaagggattcttataaaattgtggagattgtaagtgatggcgactattcgattgatgagcaaattgctgtaattgaagatgattctggtatgaggcataatattacaatgtcttttcattggcctgttaaagttcctattactaattataaggaacgccttattcctagtgaacctatgttgactcaaactagaattatagatacatttttcccagttgccaaaggtggaactttttgcattccgggtccttttggagcaggaaaaacggttcttcagcaggttacaagtcgaaatgctgatgttgatgtagtgattattgcagcttgtggtgagcgagcaggagaagtggtagaaactcttaaagaatttcccgaattaatggatccaaaaaccggcaaatctttaatggacaggacttgtattatttgtaatacatcttcaatgccagttgcagctagagaagcttctgtttatactgctattactattggtgagtattacaggcaaatgggccttgatattcttcttttggcagattcaacttcaagatgggctcaagcaatgagagaaatgtctggacgccttgaggaaattcctggcgaggaggcttttccggcatatcttgagtctgttattgcttccttttatgaaagggcaggtattgtagttcttaataatggggatattggatctgtaacagttggtggctctgtaagtcctgctggtggtaattttgaagagccagttactcaagcaactttaaaagttgtaggagcatttcacgggcttacaagagaaaggtctgatgctaggaaatttccagctattagtcctcttgaatcttggagtaaatataaaggcgttattgatcaaaaaaagactgaatatgcaagatcttttttggtgaaaggtaatgaaattaatcaaatgatgaaagttgttggagaagaaggcataagtaacgatgattttttaatttatttaaaatccgagctacttgattcgtgctatttgcagcaaaattcatttgattctattgatgctgctgttagttcagagcgtcaaaattatatgtttgatatagtttataacattcttaaaactaactttgagttttctgataaacttcaagcaagagattttataaatgagttaaggcaaaatcttttagacatgaatctttcttcttttaaggatcataagtttaataaattggagcatgctttgggtgaattgataaattttaaaaaggtaatt

SEQ ID NO: 277 - DNA, 1194 bp, Borrelia burgdorferi sensu stricto
gtgataaaaaaggtagctattattgatggacttagaacacccaatttcaagtttggaggttcttttaagggtttaaatattattgatgaatcttcaaaagttgttaaagctttgcttgaaagaaataagttatacaaagtggatgaggttattattggtaatgtaatatctgcgggacttggtcaaaatattgcaagacaaattgctttaaagtctgacttaggcgatactgtgcctgcatttagcgttaataaagtttgtggttctgggcttaaggccttggagcttgcatttaattctattgcccttggagacaatgatattgttttagctggaggagttgaagatttaaccaattctccttatttattacctagaaagattagatttgacggtcttaaatttggtaattttggaattgaagattcaatccaaaaagacgccttaatagattctctgaattttatttctatggggcttacggctgaaaatctttcagaaaaatatagaataacaagagaaatgcaagatgaatttgcatataattctcatgtaaaggcattaaaggcaagagagcttggatattttgaggatgaaatttatcccctgactgtttttgataagaagaccaactctagcgtaactatctcaagtgatgaggaaataagagataatttaactttaaataagctagcatctcttaatcctgtttttaaagaatcaggcacagtaactgccggaaattcttcaagtttaaatgatggtgcttgttttttaattttagcaagtgaggaaagagtaaaaagcttggggttaagtccattagcttatattggaggatttaaaagcgtggggcttgatccactttatatgggttttggagcttatatggctattgaaggcattattagtaaattaagtttaaatcctagcgaaatagatttgattgaggtaaatgaggcatttgcagctcaagcattaagcattgaaaaggccttgtttaaaaaatacaatataactagcgatattattaatgtaaatggtggtgctattgctttggggcatccatttgccgttagcggttcaagaattttattaacactttctcgctctatgaaaatgaagaataaaacaaaagggatagcatctgtttgtattggtggcggacaaggaatttctagttttttgtataga

SEQ ID NO: 278 - DNA, 1659 bp, Borrelia burgdorferi sensu stricto
gtgagaatggaaaatcaaaaagatttacaagaaaattatttgaaagtacttgaaagagtagaacttggaagtcgtgtttctgggacagttgttaacattatgaaggattatgttctagtagatattggttataaatcggaaggctttattaagattgaagaatttgaaaacgttccccaagttggtgatagacttgaagcaatcgttgtaagaataggtggagaattaggtcttattttaagtgttgaaaagcttaattctttaaattttcaagataaagtatatgaatatattcaaaataaaaaaataattaaaggcaaggtgctggttgagcttccaaatggttataagattcaaattaatgaaaatgtttctggctttatgcctttttatttaagctctaaatctaaggatgagaaattaaaaagagggtctgttgttgaattttatattcttgaagcaagcgaagcagacggtttgagacttattcttgatagacgcaccctagaaaaagaaagagatcttgctaagagaatagagctagttagttcttataatgaagaagatgtagttgatggtgtggttgagcgtattacagaatatggtgcgattgtaaaaattaaaaattttgttacaggaattttgcataaaagaaatattgcctttaatcaagttgaaaatgttgaagattttgttagagttggtgataagttaaagttgaaaattattaagataaatccacaaacaggcaaaatggaattgtctcttaaggccttaaaagcaaatccttgggattctgtagatgttaaatataaaattgatagcattgtaaaagggaaagttgtaaaaattttaccctttggggctgttattgaacttgacagcgaattgtcgggatttttacatataagtaatttttcttggataagagtagtaaaaagtcctcaagaattaataaaacttggccagattgtagaagttaagattttagagatagataaagaaaatcaaaaaatatccctaggcattaaacagatcaatgagaatccttgggagagattaactgagaaatatcctattggaagggttgttcaaggagttgttactaatattacaaaaacaggtgcttttgtaaatattgaagaaggtatagatgcttatgttagtaagtttgatatttcttggcttgaagagattgatcctgaagaatatttcaagataggcgatttagtgaatgggaaagtgcttgaggttgacaagagaaagagaaatgttagattaggaattaagcagctagaagagagcccctgggaagatttttctaaaagctataaaaaaggcgatactattgaggttgagattgtagagaaaaaatcaaaaggctttcaagtaagagtttataataaaataatgggatttattagtaaaattcaattgggggatacaaaagaatctagtttagaaactttcgaaaaattaaacgttggagataagcttaaagtggtaataacaagtattgattctaaagacaaatcagtgctgctctcttatagggagtatgaaaatcaaagatcaagagaagaaatttcttcttatttatttaagggcaatgatgaggaatcttacaagccatttgagaatttgctaaagagggatgaa

SEQ ID NO: 279 - DNA, 1887 bp, Borrelia burgdorferi sensu stricto
atgaccaaaagaatgcttaataacacttatcgaataaaaacaatattaacaatattcttggctataactttgttaactatttacaaatatttcacactaatggccttcaataacagcccagacaacacaatatctttaaagtcaaatgatattgccaaaagaggaacaatttatgatagaaatggcaaaccaatagcattctcttcaaaatcctactcaattggtacaaatcctcaaaaaatagaaaatattgtaagcacatctgaaactcttggtgcaatacttcaaattaattcaagaattttaaaggaaaagctttcctctaacaaagggtttttatatataaaaagaaaaataaaaagagaagaatcagatttaataaaaagaattcaagctgaaggcaggctttcaaacatcactttatatcctgattacacaagaatttatcccttcaggaataccacaagcaatattactggttttgtaggaacagataatcttggccttgagggcattgaattttccctaaatagcatattaggaaaagataaaaccaagcaacaatttttaaatgaggagccagaaacaaacaacatccacttaacaatagacatggatatacaacaaggtgttagcaaaatagctaaaaaatactttaaagaaaataatcctgaaagtttaattaccttggtaatgaactcccaaaatggagaaatattatccatggttcaatttcctcaatatgatgcaaacttttattctaaatatcctgaagaaatccgaaaaaacctttcttcatctctaacctatgagcccggaagcattaataaaatttttacagttgcaataatattagaaagtggaaaattaaatttagaagaaaaatttttagacaatggaatatatcaaaaacaatttccatcaggagaaaaaattacaatcaaaacattaaatcccccctataaacatatcgactctacagagattttaatttattcatcaaatgttggaatagcttacattactgaaaaagttagcaatgaatacttttataaaaaacttttagattttggctttggggaaaaagttggagttccatttcccggagaaacaaaaggactgctaaatcattattcaaaatggtcaggacgaagtaaagctacaattggatttggacaagaaataggagtgtcagcggttcaaatattacaagctgcaagcatactaagcaataatggaataatgctaaaacctagaataataaaaaaaataagcaacgataaaggagaaaatattaaagaatttgataaagaagaaataagaaaagtaatatccaaaaattcagcacaaaaagttttaaaaatgatgagagaagttgtaaataaaggtggaattccaaatcttaaaattaaaaatcttgacatttctgcaaaaagtggaacatctcaagctattgatagaaaaacgggaaaatactcagaagaagactatacatcttctatattggcaatataccccacagaacaaccaaaatatattatttacattgtatacagatacccaaaaaaaataatatacggaacaagaatagcagccccaatggcaaaagaaataatagaatttattgagcaccaacaaaatacaatagcatataaaaaaattaaaatgccatcaaaaatcaagatccctaaagctgaaactaattacaaaaacaaaacatacttaccaaattttatcaacctttctaaaagagaagcaatagacatactaaaatactataaaaatactatgaaaataaaaataaatggcgatggatttgtttacaagcaaagtatatcccccaatacaaaattagaagatataacagagcttgaactgtatttaaaa

SEQ ID NO: 280 - DNA, 1008 bp, Borrelia burgdorferi sensu stricto
atgattatcaatcataatacatcagctattaatgcttcaagaaataatggcattaacgctgctaatcttagtaaaactcaagaaaagctttctagtgggtacagaattaatcgagcttctgatgatgctgctggcatgggagtttctggtaagattaatgctcaaataagaggtttgtcacaagcttctagaaatacttcaaaggctattaattttattcagacaacagaagggaatttaaatgaagtagaaaaagtcttagtaagaatgaaggaattggcagttcaatcaggtaacggcacatattcagatgcagacagaggttctatacaaattgaaatagagcaacttacagacgaaattaatagaattgctgatcaagctcaatataaccaaatgcacatgttatcaaacaaatctgcttctcaaaatgtaagaacagctgaagagcttggaatgcagcctgcaaaaattaacacaccagcatcactttcagggtctcaagcgtcttggactttaagagttcatgttggagcaaaccaagatgaagctattgctgtaaatatttatgcagctaatgttgcaaatcttttctctggtgagggagctcaaactgctcaggctgcaccggttcaagagggtgttcaacaggaaggagctcaacagccagcacctgctacagcaccttctcaaggcggagttaattctcctgttaatgttacaactacagttgatgctaatacatcacttgctaaaattgaaaatgctattagaatgataagtgatcaaagggcaaatttaggtgctttccaaaatagacttgaatctataaagaatagtactgagtatgcaattgaaaatctaaaagcatcttatgctcaaataaaagatgctacaatgacagatgaggttgtagcagcaacaactaatagtattttaacacaatctgcaatggcaatgattgcgcaggctaatcaagttccccaatatgttttgtcattgcttaga

SEQ ID NO: 281 - DNA, 1995 bp, Borrelia burgdorferi sensu stricto
ttggcatcaggattttttgttcctggacttgagagtaagtacaatactaaagaaattcgtgaatccatgcttaagtccgataaggctaaaattgattcttcttttaagaaacttgaatctttagagcaagagaaaagtgcctggcagttaattaatagaaaaatctctactttaaattctcttgcaaaagaacttacatcactcaacagtccttttaatctaatgtcaggaaattctagtaatagcgaagttttaactttgtctactagatatggatctaagaatgagactcataaattaattgttgatcaaatagcgtcagctgatgtgtttttgtcttcaaattttgatcctaaaaaagttacaatcccagagggagattatatatttttagttggcaagaaagaaattaatgtaaaaagtaatggcaacattgatttacttgtgaaggatattaataacaagggaaagggctttttatctgcaaaaatagtgaaaagtgataaaaatggaaatagtcgttttgttttgcaatccttaaaggagggcaaagaaaacaagcttgttatcaaaggggagggattgtcttttgctaagcaaattggaattttaagtgagcttaaaaccaattttaatcctaatctttcagatattgttgtaaatcaatctagcagcaacaataaacttgcttttgagaacaatggtcttgttttaaatccgctttcagaagtatcaattgaaattcctgaagatattgaaattacatctaggagtaagattaaatttgaagttaagtattttgatacaggcttggaagagcctgatagtaagattatttttaatcccggaggggctacatttaaggatgcaaaagttgagagtgaagatagtgtagttgatcttggatctgatttaaaaacccctttggaaaaaaaatatattcaaatgaatatggttaaaatatgtagcaaggaaggttctttggagcttcctttaataaatatttcaaataattttgaagaagttgaagttgatgttggagctctttctaatttggaagaaataaatattgaaaataaagcaaataataaagtaattgtgattagcaatgttgaaatttttgatccaaaaaatagagatggtcatttgccaataaatgctaaaagttttgctgaaaatgcaaaaattaaatttgatggagtagatgttgagagagattcaaatgttataaatgatttggttccaaatgtgacattaagtttaaaaaaaccctcaagtgatatggttgaggctaaaattgaacctgattatgaggggattaagagggttcttttagattttattggtgcttataatgaggttcttgctgagattaatattgtaagctctaatgaagatcagcctaataatcaaaagtctaatatagttgaagagctaacttatcttagtgattctcaaaaagaagaggcttataaaaatttaggtattctaaggtctgaatttttattaaaaaatcttaagtccaagctagagtcaataatttttaagccttatgttactagtgatcctaatttttcaataattaatcagatgggagtttttacaaattccatttcttcttctggtggactttctagatatttaagacttgatgagaaaaagtttgatgaatcaattcgtaataatattgataatgttagagagctttttttatatgatcttaatggtgacagagtgtatgataatggaattgctaaaatgctaggagattgtctgtcgcctcttgtggcttccggaggagttatttataataaaataaagaattacgacttgaaaatttttaatcaaaaaaataaagttgaagattataaaaagaagtacgaagatagagagagaaaagtggaaggtgaacttaataccttggattttaccgttaagcgcatgaaagatcaagaaaatacattaaaggcttttgattttaatcaaagaaataaa

SEQ ID NO: 282 - DNA, 1203 bp, Borrelia burgdorferi sensu stricto
atgccaaatttttgcttatttaactcaaaatccgttttaactggaaatgataaaatagataactcagcggttctaattaaagataataaaatttttgatattgtaacgtctgacagacttaaaaaaatggatctcgaagaataccaaatgattgacacaaaaggcaattatataactcccggactttacgacaatcatattcatggatttcacggtcatgggacagaccagtgttcaacagaatcgatacttaaaatgtcagaacatttagcacaatacggtgtagtaggatttttaccaaccctttacccaagaccaatagatgaaatgattaaaacaataaaagcttgcatagcagcaattggtaaagaaaagggagctaaaattttgggacttcaccttgaaggaccatttttctctcctgaaaaaaaaggagctcatccagtttcttatcttcatgaacctagtattgaagttatgcaaaaactaatagatgcagctggtggagtatttacaggatcaaacggcaaaagaaaaacacatataagcacaatgactgttgctcctgagcttaagggtatgagagagcttgcaatattttgccttgaaaacaacataaaccttcaagcgggacacacaaatgcaacatatgaaaacatgatagaaggatttcaagttggaatacttcatacaacccattttttcaacgcaatgtcaaaacttgaccacagaaatccaaatgcaataggagcggtgttaatacacggcgatgtttcttgcgaaattattgcagatggccaccatatacacccaaaattaattttaatgcttagaaagcttaaagatataagtaaaatagtccttgtaactgacggacttactccgaattgtcaaacttgtggaaaactaattgcaaacggagacgaagtttatattgcagaagatggattattccatagcgtgaaaagcaacacaatagctggatcaacactcacaatgatacaaggtcttaaaaatttaatagaatttggtttcagcttaagcgatgctgttcaagcaagctcttacaatccaacaagaattctcaatattgataaaaagggcttaatatgtcatggatatgatgcaaacctcaatgtcctagataaagattttaatctaaagttaacaatgatagaatctaaaataatttttaacaatctc

SEQ ID NO: 283 - DNA, 1881 bp, Borrelia burgdorferi sensu stricto
gtggattcaacattttcaggaatagaaattggcaaaagaagtttatttgcacataaagatgctatgaatacagttgggcacaatttatccaatgctacaaagcctggatattcaaggcaaagagtaacaatgaaaaccgaaattcctctttatgctccacaattaaacagagccaaaaaacaaggacaattgggacaggggattgttgttcaatctatagacagagtaaaagatgaactacttaacacaagaatcattgaagaatcgcaccgactaggatactggacttcacaagacaagtttatatcaatattagaagatgtttataacgaacctgaggatcaatcaataagaaaaagattaaatgatttttgggaaagttggcacgatctagcaaatcaaccacaaggtttagcagaaagaaaaataattctagaaagaggcaaatctttttgtgaaggaataagaaatagattccattcgcttgaaagaatttacataatggcaaacgatgaaataaaaattacaacggatgaggcaaacaattacattagaaacattgcaaatcttaataaacaaatttcaaaatctcaagcaatgaaagacaatccaaatgacttaatggatgcaagagacttaatggttgaaaaattaggcaatataataagtgtatcaattgaaaacaaacaagatcccaatgaatttttaatccacgcagaaggaagacatcttgtacaaggttcaattgcaaatgaattcaaactagaagctacaaacgggcccaccagaactagatggaacattttatgggcaaataatgacaaagcttaccttaaaacgggaaagctgggatctttgcttaacataagagatgaagagattaaaaacgaaatcaatgaactaaataatatagctgccaacattatagaaattgttaatgaaatacatgaagcaggacgtggaatggataaaaaaaatggaagaagttttttttctcaagaactaaaactaactgatgatcgaggtagatatgatactaacggaaatggtcagtttgattccgttcatattttcaaaattaacagcacaaatgaaatatttccagaagaaaaattgggattttacggaactcttaaatttgaagctacaaatagtaatgaaattgtagaaataccctacaatgctccagatacagttcaagatgtaataaatagaataaataattccaacgcacaagttacagcaagaattaactcagaaggcaagcttgaaatcaaagcagttaaagaacaagaagatgagaatataacatttaaaatcaaacatatagaagattctggatcatttctaacaaaatatacaggaatattaaatgcatctggacctgagggagcttatgattataaaaatattgacacaacagacaaattggcgcctaaatcgacttattcaatctctcctctaaaaaatcctgcagcatggataaaagttgcagacataatagactcagatccttcaaaaatagcatcgggaattaaaaatccaacaaatgaaatatctattggagataaccaagcagcactaagaatctcctcttttggaaattctcagattatgattggcaaaaatttaacattaaatgattactttgcaaatacagcatcaaatatagcaataaaaggacaaatttcagaaatcacaaaagaaagccaatctcaaatattaaaagatttaacagatctaagaatgtctatttctggagtaaacaaagatgaagaacttgcaaacatgatcgaatttcaacaagcatttattgcagcaagtaaatttatcactgtttctgttgaactaatagacacagtaataaataaaatgggagta

SEQ ID NO: 284 - DNA, 738 bp, Borrelia burgdorferi sensu stricto
atgtctggccctaaaaaacttgctataatagcgctcttagtaatttcaatacaaggatgcaaagaatcttctattattgaaaaacaatttaattatgcaataattttttcagatgcaactgaatatttttttgaaattcaaacaactccattcataaaaaacgaaatactatttataaatgacaaaaatttagaaattataaaagacaagcttaaaacaacaaaaaaaatactattaactcataaatcaaataatgaaattctaaataacgaaattctaaaagagaaaattttttatctatcaaaaataaaattttctctaaaaaaatctattgactttctgcttaacgaaaaatcaatagatttgcaaaaaacattactatttagagacaaatctctaaataacgaagaccttgaatacttggaaaaaaaaggcaaagaaaaaaatgtcaatattactctaataaacgaaaaaaacatatcctatattcaaacattcattacttctcaaataaaaacaataatattattctctttaagagataataatattattttaaaaaagatactaaattcgcctttttctaaaaatataaaatttgtattaattggcaatacaagaaaagacttaaaaattattaagctaaaatatataatcacccttaaagagcctgatttgataaaaatagcaaaagatgttgaaaaagattttcaatatgaatttaacatttataaacaa

SEQ ID NO: 285 - DNA, 1068 bp, Borrelia burgdorferi sensu stricto
atgttgatatttggtggcgtttcttttgagcatgaaatttcttgcaaatctgcttatagtatttatttagcccttttggatctaaataaatacaatatttatcctgtttatattgataagtgtacaggtgtttggtatttattagattctgtttctgatcctcccaagcccattaatacagatgttttacctattgttagtttattgccaggttttggaattttttcaaacaataaaaatcttgaaattgatgttgtttttcccgttgttcacggaagaaccggtgaagatggcgctattcaaggggttttaaaggttatggacattccttgtgttggtgctggtattatagggagcgccatttctagtaataagtatttttgcaaacttttgcttaaaagttttgatatccctttggttccttttattggatttagacagcatgattattttttagacaaagaagaaataaaaagaaatgtaaaggaggttttaggctatcctgttattgttaagcccgcagtattagggtcttcaattggaataaatgtagcttacagcgaaaatcagattgaatcttttattaaagaagctttaaagtatgaccttactattgtaatagagaagtttattgaggctagagaaatcgaatgttctattattgggaatgaaaagatgaaaatattttctcctggggaagttgttgtgcaagattttatattttatgattatgatgctaaatattctgttattcctggaaattctattatttttaatattcctgcacatcttgagacaaatcagttattaagcattaaagaatatgcttttcttacttataagaatctagaactcagaggtatggcaagagttgatttttttgttgaaaaaaaatcaggaactatttatcttaatgaaataaacactattccaggatttaccgatatatctatgtttgctaaaatgtgcagcaatgatggtcttcagtttaaagacctggtggataatttaattgattatgcttttcaaagttacattaataggaaaaaaaggattgattttgaaaat

SEQ ID NO: 286 - DNA, 3357 bp, Borrelia burgdorferi sensu stricto
atgaataaaaaacatacaaatttttcggtattattgcttttaattttcttacttatcttatcatttgggggctttggttactatatatatcaaagcaaattaaatgacaaaaatcgagaaataatgctaaacgaagttaaaaatagcgtaatagatcgaaactataaaaaagcatattctgttgcaaaacttctgcaagacaaatacccccaaaatgaagacattgcaatgcttacaaatacactagcagaaattgccaacagtagtccttttgaatcaaaagacttgcaaagagattctgctaatcaaatcttagacaagatcaaaggtcaagacaatacaaaaacaaatgtaaacgaaaattttgatatagcatttaataatagatacattaaagacagcacaataacagaaaactactctgacagaaacgatgatgttggcattgaagatgaagacatatctgaatttaaaaaaagcaaaatcccagaaaaaataaaaccaaatacaaacccaaaagaagaagaccaaataatacaatctccaaatccgaaattaagtgttaatgaccaaaaaaatttatttaatttggaaaaactaaaaaaaaatttaagtggaaaatcaaatagtgaaaatattttaaacgattctcaaaaaatagaaaatgataagcaaaacacaaatttatccaaagaaaaaaattcggagaatattttaaaaactccggacaacagtaaatattcaaacaataacaatactacatctttaaaaaaaatttcttcaaattcccaaaaagaaagtgagctttctccacccagtcaaacaataatagggaaaatttataggccatatagctacttgataaaaaaagagctctatgaaatattagacgatattaataccggaagagtcacacttggaaaaaacagattaaaagaattaattaaaaaaggtctaagcaacaaatttcaaaaagtaaatgaattgattgaaaattcaaaaaataaagaagcttcaaatttactattaaccttaataaaaaaagatattgaaccaaatctcattaatataccaaaagatccttacaaaaaagaaatttttcaattagataaagaagacaaaaagcctcagtacctagaggaccttaaatctaaagttcattcaataaaacccattgatcttgaaaacacaaaatcacgccaacaagccattaaggatctaaacgaattcttgaaaaacaatcccaatgacgctcaggcctctaaaactttagctcaagctaataaaatacaacacctagaggaccttaaatctaaggttcattcaataaaacccattgatcttgaaaacacaaaatcacgccaacaagccattaaggatctaaacgaattcttgaaaaacaatcccaatgacgctcaggcctctaaaactttagctcaagctaataaaatacaacacctagaggaccttaaatctaaggttcattcaataaaacccattgatcttgaaaacacaaaatcacgccaacaagccattaaggatctaaacgaattcttaaaaaacaatcccaatgacgcccaggcctctaaaactttagctcaagctaataaaatacaacacctggaggaccttaaatctaaggttcattcaataaaacccattgatcttgaaaacacaaaatcacgccaacaagccattaaggatctaaacgaattcttaaaaaacaatcccaatgacgcccaggcctctaaaactttagctcaagctaataaaatacaacacctggaggaccttaaatctaaggttcattcaataaaacccattgatcttgaaaacacaaaatcacgccaacaagccattaaggatctaaacgaattcttaaaaaacaatcccaatgacgcccaggcctctaaaactttagctcaagctaataaaatacaacacctggaggaccttaaatctaaggttcattcaataaaacccattgatcttgaaaacacaaaatcacgccaacaagccattaaggatctaaacgaattcttaaaaaacaatcccaatgacgcccaggcctctaaaactttagctcaagctaataaaatacaacacctggaggaccttaaatctaaggttcattcaataaaacccattgatcttgaaaacacaaaatcacgccaacaagccattaaggatctaaacgaattcttgaaaaacaatcccaatgacgcccaggcctctaaaactttagctcaagcttatgaaaacaatggagatttgctaaaagcagaaaatgcatacgaaaaaattatcaaactcacaaatacccaagaagatcactataaacttggaatcattagattcaagcttaaaaagtatgaacactcaatagaatcatttgatcaaacaataaaactcgacccaaaacataaaaaagcacttcataacaaaggaatagctttaatgatgctaaataaaaacaaaaaagcaatagaatcttttgagaaagcaatacaaattgataaaaattatggcaccgcctactaccaaaaaggaatagcagaagaaaaaaatggcgatatgcaacaagcatttgcaagctttaaaaatgcctacaatctcgacaaaaaccccaattatgcattaaaagcaggaatagtatcaaataacttgggcaacttcaaacaaagtgaagagtatttaaatttttttaatgccaatgcaaaaaaacctaacgaaattgctatttacaacctatcaatagcaaaatttgaaaacaataaacttgaagaatctcttgaaacaataaacaaagccatagatttaaatccagaaaaaagtgaatatttatatttaaaagcatctataaatcttaaaaaagaaaattaccaaaatgctatatcactttacagcttagtaattgaaaaaaaccctgaaaatacttcagcctatataaacctggcaaaagcatatgaaaaatcaggaaataaaagtcaagcaatctcaactcttgaaaagataataaacaaaaataataaattagccttaaacaatcttgggatactttacaaaaaagaaaaaaattatcaaaaagcaattgaaatttttgaaaaagcaataatcaattcagatattgaagcaaaatataatcttgcaaccactctaattgaaattaatgataacacaagagctaaagaccttctaagagaatatacaaaattaaaaccaaacaatccagaggccttacatgcactaggaataatagaatataatgaaaataacaatgatcaaacactaagagaacttataaaaaaatttccaaattacaaaaaaaatgaaaatattaaaaaaataataggaata

SEQ ID NO: 287 - DNA, 840 bp, Borrelia burgdorferi sensu stricto
ttgatgaaaaaagttattatcttaatttttatgctatcaacaagtttattatacaactgtaaaaatcaagacaatgaaaaaattgtatcaattggaggatctacaactgtaagcccaatactagacgaaatgattttaagatataataaaataaacaataatactaaagtaacatacgatgcacaaggaagtagtgttggcataaacgggctatttaacaaaatatataaaatagcaatatcatcaagagatttaacaaaagaagaaattgaacaaggggcaaaagaaactgtatttgcttatgatgctttaattttcattacaagccctgaaataaaaattacaaatattacagaagaaaatctagctaaaatactaaatggagaaattcaaaattggaaacaagtgggaggtcctgatgctaaaatcaactttatcaatcgagactcttcttctggttcttattcgtctataaaagacctacttcttaataaaatattcaaaactcacgaagaagctcaatttagacaagacggaatagtggtaaaatctaatggagaggtaattgaaaaaacaagccttactccccactcaataggatatataggtcttggatacgcaaaaaattcaatagaaaagggtttgaatattctttctgttaacagcacatatcctacaaaagaaacaataaatagcaataaatacaccattaaaagaaatttaataatagttacaaataacaaatacgaggataaaagcgtaactcaatttattgatttcatgacaagctcaactggacaagatattgttgaagaacaaggctttttagggataaaaaca

SEQ ID NO: 288 - DNA, 1224 bp, Borrelia burgdorferi sensu stricto
atgaaagttatgcaggatcctaggctttccaagtataaaaatgctaaaaatttaagcaaaaaaaccgttgaagaaattgatactttaagtttaaataaaaatttttccgattcagagattcaaggctctatgcttagatcttggataagccttattaaaggaaataaaaataaaacacctgtcgagcctaaatccaacaatattaatgagttaaagccagggtttattcgcaaagagagtaaggtcacaaagattgcaaaatattttttggctattggacttgaaaaatctgctaagattatgtctgagcttgatgattcggatataatcttaattaccagagaaatttcaaagattagctatattgctccagaagaaaaagagcatattattaaagaatttgaagagttactaagaaatcaaaaaaggtatgttaaggttgatgataactttgcttatgagttattaaataaaacgttaggaaaatctaaggcaaaatcaatttataaaaaagttactggtaatgatatttttattccttttgattatttgtctcaaattgagcatgaacaactttgggcattaattaaggatgagaatattaaaacgcttgttatattatataattatttaaataaagatcaaaaaaaatatgttttttcaatgctagaagaagaagatagaagaaaatttgtaaaagatcttgtcaaaccaaggcaattgagcatggagacaatagaggcaatttcaaataagcttaaggatagatttaagatgcaggggaatcttaagacagataaacttgatggatctaagatacttgttgatattttaagctatatggattttaatgaagagaaaaatttgcttaataatattaatatgcgggatttaaatcctgttgtggacagtgaaattcgagaaaaaatatttgatatcaatgtaatattgagaataatggataatgaccttcataatattttaagagagtttacagacaaagagattgcaattattattaaggataaagctgatgaggttagagataaaatgctttcaaatgtttcaaaaaggcgcaaagaaatcattttagacgaagaagcttttttaggaaaaataagtaaaaaagatttaaaaactatgacaacagcttttgttaattatattaaaaatttaactttaaaaggcgatttaataatatatagaaaaaatgaggaatttatt

SEQ ID NO: 289 - DNA, 2004 bp, Borrelia burgdorferi sensu stricto
atgttaatttttggttttattggtttgttttttttaaatatttttagtttgcatgcccaaggaatagttactaataaagatgctcaagaagagtttaaatgggctcttaattcttataataatggaatttacgatgatgctcttttatcttttaaaaaaattttaagctttgatcctaataatcttgattatcatttttggactggcaatgtttattatagactgggttatgttgaagaagctttaatggaatggagaaatttaaaagatcaaggctataaggttccctatcttagacatttgatttctactattgagcaaaggagaggtattttttcaaattatgaacttaattttaaaaaacttgtaaaagttgcttctcttgataattctatttataaaaggccacatgggtaccagattacatctttaagggctgataagtacggcggatattacgctgctaactttgtaggcaatgaaatattgtattttgatgttaataacaatgttaatgctttagttaaagatggctttagttatttaaaatcaccttatgatgttattgaagctaataatctgctttatgtgactctttattcaagtgatgaaattggtgtttatgacaaagttcttggagttaaaaggaaatctattgggaataaaggcacaaaagatggcgaattgcttgctcctcagtatatggctattgataagagaaactatatttatgtaagtgagtggggaaataaaagagtaagtaaatttggacttgaaggtgattttattttgcattttggttctagaacttcaggctataagggccttttaggtcccacaggcgttacttatttgaatgaaaacatttatgttgcagattctctgagaaataccattgaagtttttgatactagtggtaatcatttatattcagtttttacttctattgagggaatagaggggcttagcagtgattttgtaggtaataatgttatagtatcctcaaaagatggtgtttataaatatagcattgctaaaaagacaattacaaaaattttaaaagcagataaaatgaattctaaaatttcttcatctattttggatgccaataatcagatgattgtctcagattttaataatgccaaggtttcagtttacaagagtgatgcaagcctttatgatagtttaaatgttgatgttagaagaataattaggcttggagggcctaaaatttacgttgagcttaatgttagcagtaaaagcggattaccagttgttgggcttaaaagtgaaaatttttcaatttcaaatgaaaattattacattgtcaatcccaaggtggcatataatgtaaatgcttcaaaagacattaatatagcagttgtttttgataaatcttcttatatgaaaaaatatgatacagatcaaattgtagggttaaatgccctaatggagttgtcaaaaaataaaaactttagttttataaatgcaacaagtgtgcccattatagataatattgaaagcttaacaaatagcattagaaatacaagttctcttggtccttatagtacagatgctgtaaaaacagacgttagtttgaagttggcaggttctgggcttatgtcaaaaagctcaagaagagcagtagtttattttagtggtggtattttaaatcgtaaagcttttgaaaagtactctttagatacaatagtaagctattataaaaataatgatataaggttttacttaatactatttggtaatgatcctattaatagtaagcttcagtatttagttaatgaaacaggcggtgctgtaattcctttttcatcttatgaaggtgtatctaaagtttatgatttaattttagaacaaaaaacgggcacttatttgttggaatattattatccaggccctcaagaacctaataaatattttaatttatctgttgaagcaaatataaatcaacagacaggaagaggggagtttgcatattttattaat

SEQ ID NO: 290 - DNA, 786 bp, Borrelia burgdorferi sensu stricto
gtgttaatggaggttcttatgagaagattatttcttctatatattttatgttcttttgtttttttgaatttatttgctcaaggtagttcttcttatattgataagcaaaaagagcttgctattttttattatgaggttggtcaaagatatataaacgttggtaaaattaaaaaaggaaagctttttcaagcaaaagctttaaagatttatccagatttgaaaaaggggtttgatatcaagcttgcagttaaagagcttgatgctaggattaaagatgacaatcccaaggttgttatgcttgaggatattaagcttgaggagatacctggaatagtgcacgaaaaaatagaaatcaatgattttacaaatgctcctaaaatagaatatattgctcaaagagagagaagcaaaaatcaagataaaattattaagtttcaatttggaaagtttgcaagagctttaatttctaggaactttgatttgtttgattcagttattgcggataaagttaacgttatgggtcaatttgaatcaaaaaatgattttatatcaactttatcaagtgcttcatctaaggccgatgctgatgagttagagtatttatcagttgatgattattacgatttaaagtctttaaaaatttcaaaatccaacgatacttcttttgctgttaatgttaatgccaaaaaaaatgatgttactaaaaattttccattttggaaagaacgtcaaactttaatttttactacagaggatgataataattggtttttgtcttccataaat

SEQ ID NO: 291 - DNA, 1326 bp, Borrelia burgdorferi sensu stricto
atgatgaggtctttatattctggtgtttctgggcttcagaatcatcaaacaagaatggatgttgttggtaacaatatcgccaatgtaaatacaattggctttaaaaagggaagagtaaattttcaagatatgatatcgcaatctatttctggagcttctcgccctactgatgctcgtggtgggactaatcccaagcaagttggattaggcatgaatgttgcctcaattgacactattcacactcaaggagcttttcaaagcactcaaaaagcatctgatcttggagttagtggcaacggattttttattttaaaagaaggtaaaaatttgttttatacaagagccggtgcttttgacgtggactctgatcgacatcttgtaaatcctgcaaatggaatgcgaattcaaggttggatggcaagagatttagaaggtgaaaaggttataaatacagcttctgatattgaggatctgattattccgattggagataaagagggagcaaagtctacgaaaaatgttacttttgcttgtaatcttgataagagattgcccttaattcaagaaggtgcgaatcctgcagatattgcacgcggaacttgggttgtcaataaatcattgtatgacagttttggaaatgttagtgttcttgagcttagagttgtaaaagatttaaatacgcctaatttatggaatgcaacagtattaataaatggtgagcaaaattcaaattttacacttgggtttgacaatgaaggagcattggcgtctttaaatggtcaaccagggcaaaaaggagatattcttcaaattcctataacatttaatgttttgggtgcaaatgtaggtgaagttggtgagcagcaaactgtaaatttgaaattgggaacagttggaagttacactgattcaattactcagtttgctgattctagtagcacaaaggctattattcaagatggatatggcatgggatatatggaaaattatgaaattgatcaaaatggtgttatagttggcatttattcaaatggcataagacgagatcttggcaagattgctcttgcttcttttatgaatcccggaggacttgcaaaatcaggcgatactaattttgtagaaacaagcaattcaggtcaagttagaataggcgaaactggacttgctggacttggtgatattagatctggtgttttagaaatggccaatgttgatcttgcagagcaatttacagatatgatagtgacccaaagaggatttcaggcaaatgccaaaaccattaccacttctgatcaattattacaagaacttgtaagattgaaaaat

SEQ ID NO: 292 - DNA, 1365 bp, Borrelia burgdorferi sensu stricto
ttgtgcttgaggagattgaaaatgaataaattagaagagcactatatagttcccaaagatgtagttgcagaacttgataaatatataataggtcaagacgaagctaaaaaattagtatcaattgctcttgttaatagatatataaggtctaggcttccaaaagaaataaaagatgaggtaatgcctaaaaacattattatgattggatcaactggcattgggaagaccgagattgcaagaagactttctaaattaattaaagctccttttattaaagttgaggctacaaaatatactgaggttggttatgttggtcgtgatgttgaatctatggttagagatttaatgagcattgcagttaatatggtaaaagaagagatgtatagtactgtaagagatgatgctttagtaagaacagaggagagaatagttgatagtctttttaagggatctagtaattctgagaatatggatccaaatgaaataaaggcggaagaaaaggtaaaagagaagcttagaaaaaagcttagagcaggtgagcttgatgatactactattgaaatacaaatttctagtaaaatgccattttctacaatagaaatatttacgggtggtaattttgaagagattgatatgggaattggcggtttgctgggtaatatatttgatagaaaaaagaaaagagaattgaagattaaaaaagcaaaggaaataatattagcagaagagcttgagaaattggtcgatcacgaaaacatttcagatattgcaaaatctaaagttgaaaatatgggaattatttttattgatgagatcgataaaatagctgctaagaataggagtggcaatgatgtgtccagagaaggtgttcaaagagatattttgccaattattgaaggttctaaagttaatacaaaatatggaatagttgatacttctcatattttatttattgcagcaggagcatttaatttagctaaaccttctgatttaatacccgagcttcaaggaagatttcctattaaggttgaacttaagagcttaagcatagacgatttgaaaaaaattttaaaacaaacaaaaaattctttaataaaacaatatgttgcgatgtttaaggtttatgatttagatttaaagtttagtgaggaagctatagatagaattgcagagcttacttttaatatgaatcttgagagtgaaaatcttggtgccagaagacttcacggtgttatggaaatagtgcttgcagatcttttttttgaagtgcctggcagtaagttgaaaaaatttgaaataaacttggactatgttaataaaaaaatacaaattaacgaacaaaaagatttgaattattatataatt

SEQ ID NO: 293 - DNA, 684 bp, Borrelia burgdorferi sensu stricto
atgagaaaaataacaataatgatacttttctatggcttgataataaatgtttgccctactacaacaacatcaatattaaaacttaataaaaaagcaaacaaacatacaatagaaaaactttaccaaaaatcaatgttactaaaagattcaaaaaaatataataaagcaatagaaagtctaacaaaaataattaacatggatcaaaatcaagctgatgctcatcttttgctctcagaattagaatatttaaataaaaactggaaaaaagcaattattaaatctcaagattacttaaaaataatagactttaaagataaaaagaactttttagatatctcttgggcatactttttaataggagaagttaaaaattcaatggactatataattaaatttttccaaagcggtaaagaattgttcagagaaaacatatttatagcaattgatgccctttttaaaaaaagtatttatcattttacaaacaatgaaaatgcagcattcaatgcaatattatcttcaacgtttcaattagcactcaatgacgacacattgtttataatttttttaaataatttagaaataataaaacaaatacccttctatcattttaatagaaaaaaattagaagaattatatctacaaatcagcactctaaaaacaattcaaaacacaacgtgcagaact

SEQ ID NO: 294 - DNA, 1131 bp, Borrelia burgdorferi sensu stricto
atgaatataaagaataaattaatatcgctgctaattgtagtagcaatctcttttatcgcatgcaaaacgcctccagaatcaagagagagtaaaaatgctaaaattgcacaaccagataataaaaattttcaattaagagatataaaagacattaaaaatgaactaataagagaacggggacatcttttttattccaaagagtttaatgaagctgaaagattagaagaagcaatgaaacaaagtttttccaaaaaaaaagcaatagaaggaaatgaaattgctctaaaagtacttgaaagatacaaaacaataataagagaaacgagggaaaaaaaagaaaaaacaaattaccttaaagaaaatattgaaaagtatctaaacgatgcagaagcaaatgaagcatacatatggatcccgctggaaatcgacgaagtaaataatttatattttgaagcaacaagaaaatataaaaattacgatcttgataatgcccttgacatgtatagcaaggcctttaacagagcacaacaagcagcaaaaaatgccaaagaagctaaagctttaaaagaaactgatgagagaatgtacaaacaattaaaagcacttgaagcggcttccaacttaccaatttatagcaataataagcttataaagccatctccatggaatggtagagcattcattaaagaaagaaacagtcacttaaaccttttaaatactaataaagacacttatcttcttggagaagcagaaatttcaattccaatagtactcgcatacgaagaaaaagtggaaatagcaaaaaactccaaacctcaagaacaattcaaaacgctagaacttattgaaagatctagaacattgtgggaaaaaggggttgaggctaaaaatgtaaaaaactttagacttgccaatgaattatttttagaatctgcaagataccttgaagcttatcaaagcaatgcaagcagcgagctttacgtaataaaaataggcaataccctatggggcatttccaaaaaattatacaacgatccttacttatggccaaaaatttggtttgccaacagacaaaaaatacaaaatccggatctaattcattctaactggaagataataattcctgccaaa

SEQ ID NO: 295 - DNA, 1584 bp, Borrelia burgdorferi sensu stricto
atgaaattacaaaggtcattatttttaataatattttttctaacttttctttgttgtaataacaaggaaagaaaagaaggagtatcatttaaaataagcttgggagcagagccaagcagtcttgaccctcaattagcagaggataatgtcgcatcaaaaatgattgacacaatgtttagagggattgttacaggagatcctaatacagggggaaataaaccgggacttgcaaaagggtgggatatttcttctgatggaacagtttacacatttaacctaagagaaaaaatcacttggagtgacggagttgcaatcactgcagaaggaattagaaaatcttatcttagaattttaaataaagaaactggctcaaagtacgttgaaatggttaaatcggtaattaaaaatggtcaaaaatattttgatggacaagtgactgactctgaacttggaattagagcgattgatgaaaaaacattagaaataacactggaatcaccaaaaccttattttattgatatgttagtacaccaatcatttattccagtaccagttcatgttaccgaaaagtatggacaaaactggacaagccccgaaaacatggtgacaagtggtccttttaaattaaaagaaagaattcctaacgaaaaatatgtctttgaaaaaaataacaaatactacgactcaaatgaagtagaattagaagagattacattttacacaacaaatgacagctcaacagcgtataaaatgtatgaaaatgaagagctagatgcaatttttggttccatacccccagatctaatcaaaaatctaaaattaagaagcgactattactcatcagctgttaatgccatatacttttacgcgttcaatacacacatcaaaccacttgacaacgttaaaattagaaaagccttaactcttgctattgacagagaaacgcttacatataaagttcttgacaacgggactacccctacaagaagagcaactcccaactttagttcatattcttatgcaaaaagtttagaattatttaatcctgaaattgcaaaaacccttctagctgaagctggatatcctaatggcaatggatttccaattttaaaattaaaatacaatacaaacgaagcaaataaaaaaatttgtgaatttattcaaaaccaatggaaaaaaaatttaaatattgatgtggaacttgaaaacgaagaatggacaacatacttaaacactaaggcaaatggaaattatgaaatagcaagagcaggatggataggcgattatgctgatcctttgacatttttaagcatattcacacaaggatacacacaattctcatctcataattactcaaacccagaatacaacgaacttataaagaaatccgaccttgagcttgatccaataaaaagacaagacattttaagacaagcagaagagataattattgaaaaagattttccaatagcaccaatatacatatatgggaacagttaccttttcagaaatgacaaatggacagggtggaacaccaatattttagaaagatttgatttatctcagctaaaattaaaaaataaa

SEQ ID NO: 296 - DNA, 1623 bp, Borrelia burgdorferi sensu stricto
atgagctttaataaaactaaaaaaatcggtaaaaaaattaaaatagtaacactacttatgcttgctgtgtctttaattgcatgcaataataattcagaaaaagaaaaattagcatttaaagtatacatagggggagcgccctcatcgcttgaccctcatttggtagatgagacaataggagcaagaattttagaacaaatattctcagggcttttgacattaaataccaaaacaggaaagctaaagcccggacttgctaaaaattgggaagcctcaaaagataaaaaaacatatcaattttatctaagggacaaccttttttggagcgatggagttgaaattaccgctgaagggataagaaaatcttttttaagaattttaaataaagaaacaggatctacaaatgttgacatgctcaaatcaataataaaaaatggacaagagtattttgacgggaaagtatccgattctgaacttggaatcaaggcaattgatagtaaaacgctggaaataacacttacggccccaaagccatattttcttgaactgcttctacattacgcattcatgccagtacctattcatgtgattgaaaaatataagggaaattggacaagccctgaaaacatggttactagcggtccttttaaattaaaaaaaagattacctaatgaaaaaattatctttgaaaaaaacgaacgttattataatgcaaaagaagtagaacttgatgagcttgtctacattacgtctgacaatgatcttactgtgtacaatatgtacaaaaacaacgaaattgatgctatttttaacagcatcccgccggacattgtaaatgaaataaaactacaaaaagactattaccaacacaaaagtaatgcaatttatttatattcatttaatacaaaaataaaaccccttgatgatgctagagttagagaagctttaaccttagctattgacagagaaactttaacttacaaagtgctaaatgatggcacagttcctacaagagaaataactcctgatcttaaaaattacaattacggtaaaaaattggctttatttgatcctgaaaaatctaaaaagcttttggcagatgcagggtatcctaatgggaaaggattcccaatgctaacactaaaatataatacaaacgaaactcataaaaaaattgctgcatttattcaaaaccaatggaaaaaaattctaaatatcaatcttatgcttaccaacgaaaattggcctgttcttaccaacagcagaaatactggcaattttgaaataataagagttggacgcattggggaatatttagatccacacacatactttactatattcacaagagaaaattcacaacttgcatcatacggatattcaaacctagaatttgacaaactcatcagagaatcagatcttgaaaaagatcctataaaaagaaaacaattactcagaaaagcagaatcaataataattgaaaaagattttcctgctgcaccaatatacatatattctgggcattatctttttagaaacgataaatggactggatggaatcctaatgtatcagaggtttattatctttctgaattaaaaccaattaaaaatgcaaaacataat

SEQ ID NO: 297 - DNA, 1194 bp, Borrelia burgdorferi sensu stricto
atgaaagaaaatgattttattaaatttgggagttatttgagaaaagttagagatagtaaaaatttgactcttgaaatggtagctgaggatattaaaatttctattaagtatcttaaggctcttgaagaatctaatattgaaattttcccaaacgaagttttggctgttggatttttaagaacttatagcgaatatttagacattgattctagattgatatcaacactttttaaggattataaaagtagacttaataatagttatattgggattaaatctgaagataaaatttcaaatttaggatttttaagcgacaataaagtttcagaaaaaaaaatatttttttttagtttagaatctttaagtatttttaaagtctttttaggcattgttggtgttcttttattatttgtgtttctctattttagagaagtggaaggctattttaaaaaatttttcaatcttagtcaggatgaaaagataatttcaaatattcatgaagtgtcttttgataaaaagaatttttggaacgtttctcttaaagagggagattttttatctttaacgtatagtgatgatattgcaaaatatagagcatcgtttattggcgatgatttagttattgttgatgagtctaaaaaaagtaagaatattttaaatttaggagagtttaaagagataaatcttgatgataatattagagtcaaaattatttatgagaattattattatgataagttgaaaatagctcatgtaagtttagagtcttttgctttaaatgttaaatatgtatctgaaactaatattgacaatagatttaatattttaaattggcagtttgatgttaagggaactgaaaaattgccgagcagcaattatcttaccctatattcttctcaaaaactttcaaatgttgatttgaaaatcgattttttaaatgatacattttttagatatgccgatgaaaacaatctttatgggaagtctctttttgcatccaaaggtattcctattaatttagcttttgaaaaatctttgatactatttttttcaagactttctgatgttaatatcattcttaatgacagagacattactccttttttaaaagagcagggaaaagaaatttttgctgttcaatttttttgggtaaagaccccctcagggtttgatcttaaggtttctgaagtttat

SEQ ID NO: 298 - DNA, 1425 bp, Borrelia burgdorferi sensu stricto
ttgataaaaatgtctttgaattacactgaaataaatactttgattaaagaaattcctttcacaaactctttaataacaaaaataatacaaccggattacaaaagtttggttttagagatttacaataaaattgacaataaaaaatttaaaatactaatctgcttaaatccaaacactacaagattccatataacaaaaaaaaatttcaaaaagaatgctttaaaattaagattttctgacttcttaaaatcaaaaattcaaaatggaaaaattataaaagctttccaaatgaaaaatgaaagaatcatttctcttgagattttgcaaaaagatatgattatcttatttattaaattgtggccatcctcgcccaatataatagctacaaattcaaactttaaaatactagatgcatattacagaaggccaaaaataaaagaaacaacaggtgaaatctttttaaaagctaaagaaatacatgaaagcaataaaatgtctgataaaaaaattatggaactaaaggaagaatataataataccagctatacatcttattctgaatttcttgaaaattactacgaatcgcttaatgatcaaattaaaaaaaccaatataaaagaattgcttattgaaaaatataaaaaagagttaattgttttagaaaaaagaatagactctttaaaacaacaaattaaactgcttgaaaacattgaaaacgaaaaggaaaaaggcgaattgattttattaaatattaacaaaatacaaaaagggattaaagaaataaacctcttaaattataaagaagaaaaaattaaaatatccttaaaccaatcattatcaccaaaagaaaatgccttgcaatattttaaagcatataaaaagggcaaaaattctttcaaaaccatacaaaatcaattaaaagataatctagataaatttaatttaattcaatcaaaaataacaatgttaaaagtcgaaaatttaattccggaagaagaatataatcaagaaaaaactgctattaaagaaaaagaaaaaacgccaaaaataggcttgcattttacctattgtggatttgaaattcttattggaagaaacgcaaaagaaaacgataaacttttaagacattgcgttaaaggaaatgactattggcttcatacaagagattatcctggagcttatgtttttattaaaaatcaaaaaaataaaactcctagccttgatgtccttttaggtgctggtaatttatgcgtattttacacaaaattagcaaaaaaatcgggaaaagccgatctttactacactcaagttaaaaatttaagaagagttaaaaataaaaagctgggccttgtaattccaaaagcagaaaaaaatttacatattaagctagatgaaaatctaataaaaaaaataaaaaatcaaacc

SEQ ID NO: 299 - DNA, 1797 bp, Borrelia burgdorferi sensu stricto
atgaaaagagaaatatatgcatttttgagcaattttattatttttatgtgtttttttctaggtttgctctttagttattcatatttttttggagaaaattttttagaaaagcataaattaatagcaactttttttgattctattttgcttttttataagtatttttttgggttttttatttttattgtttgtatttactttgctttttttgttcagcaagaaataaagattcatttaaaatcgcataatggatatttattttccaggctttatgcatttttactattattttttattataggactcttttttacttttatatttaatttaattttgccttatataattgctcagagaaatgagtataagtttagttatgatagatataatcttcttgaaagtgaagcaaatgaaatatctcttaaaattaaacatatagatataagtttggctgcaaatagattttttttatcttctgatttgacagattcaatgaagcaaaagagaaagcatcttgaaaatttgattagaatatatgataaaatgcgaattatttatgtaaataatgaagagcttttaacaaattattatttagtgaaatctgaatatagtaaaattccaagttatgacgttgatttagaaaaagttaaaaaaactttttcaaaatatcctttgcaaagtcttaaaaagcaagatttttttaatattgtcaatgaatttatttctaaaaatgattattatacagccaattattttgcttatattgcttatgttgcaacaaaagacgataattttgttgtgcttttaaatttgactttaaagtttattaatgaaaacaggaattttgaaaaagaaaaaatgcagttgatttccgaagaaaagcaaaaaaattttttgtttcttaatactgaaaaatttaaattagcttattacgggttttcgaatctttataagttattgcccagcgataatgaaattttgaattataaaaataaatctcttgaaaagcttaggaaaagatatcttttttttgatgagattgaaaaatattttgaatattacggaataaacgatgtatttttattgcaaccagattctaagagaggtttttatgattatatttatatgcaaaaagttgtggcctttaacaatcattctaaaataataaaaaattttgaacttattagatttaataatacagggaatgttatattacatattaaaattccatttgctactttgaagggtaattctgtgtatcaaaatattttagataaagacaatgagcagagcgaaattactcttaccaaggtctttgtgtctacggatagctttgatacaaatgttttagaggttgtcaaaattaatgagaatgtagaaaatttagctttattttcaaattttactgagtttggattttttttaaaaattcaaaatttgccaagcgcttttcatagggttgctatattaaatttgaaattaattaatactttttccttaagtttggttttgctgatttctcctatttcgctagttttaataggggcattttttatctctttgttttctaaaatagaatttaatttcaattccaaggctatgatttttctagtttcattaatgatagctattttctcagggattacttgtctttttgtaaattattttctaattgtttttacctctcttcttatatatgtttttaatagcgtttacgtatctttagctattctttctgcattattgttttttcttatttttaaaataattactttgaattacaaggaaagacttatt

SEQ ID NO: 300 - DNA, 1425 bp, Borrelia burgdorferi sensu stricto
atgaaaaataaatttttaatatgtgtatattttttattgactctgggtataagctctttagtaattgttgaatctatttttgcttttgatgaatctaataataagttatcaagatcaaattatgagcagatgatgattcaagcttttgaatttgtaaaagaaaattatgttgatcctgtaagtgatgaagtaatttttgaaggtgctttaaaaggaatatttcaatccctaggcgatccttattctcaatatttgacaaaaaaagatttagaagaaatttcaaaaacaacagtaggagattatgttggcattggaatttctataataaaaaaaatgcattcccaagataagcaagacaaggcaaaagattttgatcctaatagtgcttgtgtttctattgttacgccttttgaaggaggtccggcttataaggctggaattaaatctggagattgtattaccgctgttgatggcaagagtgtttattctatggaagtagatcaagttgttgatcttttaaaaggtaaagaaggcacaaaagttaaagtatctattcttaggggaaaaaatttaacattggattttgaacttacaagagagaagatagaaatacaaacratcaagtatgacgttattaattcagatattggctatataagaatagtaagctttaatccacacacctctgtagattttagaaaagctttagataatcttaagaataaaaatattaaatctttaattttagatttaaggcttaataccggaggatattttcaggcagctataaaaatggcggatgatattttatctaaaggaattattgtttccacaaaatcaagaaattctagcaagcctattgattataaggcaagctcaaaacaagttttgccttcaaatataaaaattgttgctttaatagacagatcatcagcctcagcatcagaggtttttgtaggagccttaaaagacaataagagagcatacattataggggaaaagtcttatggcaaggggcttattcagcatgtagttcctttttatactggtggatttaaaattacaagctcaaagtattatactccatctggaaagagtattcataaggttggaattgagcctgatttggaaataaaatctccagatttttctgaggaggaggcattaatatataaagaaatttttgataaaaagctgatagaaggttttttgaagggtaaaaaattcattaccgaacaagagattgatttttttgttgagaatcttgtaaaagaaaatccaaaatataaaattgataaagaatttttaggcaagtatgtgttttttaattactatcaggacaataataaagaattgccaatttataatctacattatgacaaagttttaaaaacagcttgtgagtatttgtctaaattaggtaat

SEQ ID NO: 301 - DNA, 1374 bp, Borrelia burgdorferi sensu stricto
atgaaaaaacaaaatccatggatatatttaaatgaagaagaaaaaaatcaaattttaaatttttctgaaagttacaaaaaatttataagcaaattcaaaacagaaagagaagttacagcctatgccctagataaagcaaaaaaattggggtttattaacgctgaagagaaaaaaaatttaatgccaggtgataaaattttttatacctgtagagaaaaatctgttgcttttgctattattggcaaaaatcccattgaagatggaatgaattttattgtttctcacacagattcaccaagacttgatgcaaaaccctcaccaatctctgaagaaaatgaacttacatttattaaaaccaactattatgggggaataaaaaagtatcagtggttatctacacccctttcaataagaggggtggtatttttaaaaaatggagaaaaggttgaaatcaatattggagacaatgaaaacgatcctgtatttgtaattcccgacatcttgcctcatcttgatagaaaaatacaaagaaataaaaaatcagatgaaattgttgaaggggaaaatctaaaaattttaattggaagcctgccaatcgaaacaaaagaaaaaaataaagttaaactggcaactttgcaactaataaaagaaaaatacaaaatagaagaagaggactttgtatcatcagaaattgaaatagtgcctgcaggaacagcaaaagacgttggatttgacaaagcgttaattggggcttacggacaagatgacaaaatatgcgtcttcacttcactagaatccatatttgatcttgaagagactccaaataaaacagccatttgctttcttgtagataaagaagaaattggttcaacaggttcaaccggactagactcaagatatcttgaatattttgtttctgacatgatcttcaaaattaaaaaatcagaatacaacaatcttcacgtccaaaaagctttgtggaattcaaaaagcatttctgctgatgtttgtgcagcaataaacccactatttagttcagttcatgacgaacaaaacgctccccaacttggctatggaatacctataatgaaatacacaggacatggtggaaaaagtatggcaagcgatgctgatgctgagcttgtttcttatattagacaattattaaataaaaacaatatagcctggcaagtagcaacactcggaaaagtagaagaaggaggaggaggaactgttgctaaattcttagctggctatggaataagaacaatagacatggggcctgctgttataagtatgcattctccaatggaaataacttctaaatttgatttatacaatgcttacttagcatataaagctttctacagagaa

SEQ ID NO: 302 - DNA, 1032 bp, Borrelia burgdorferi sensu stricto
gtgctttatatgagaattgtaatttttatattcggtattttgttgacttcttgctttagtagaaatggaatagaatctagttcaaaaaaaattaagatatccatgttggtagatggtgttcttgacgacaaatcttttaattctagtgctaatgaggctttattacgcttgaaaaaagattttccagaaaatattgaagaagttttttcttgtgctatttctggagtttattctagttatgtttcagatcttgataatttaaaaaggaatggctcagacttgatttggcttgtagggtacatgcttacggacgcatctttattggtttcatcggagaatccaaaaattagctatggaataatagatcccatttatggtgatgatgttcagattcctgaaaacttgattgctgttgttttcagagtagagcaaggtgcttttttggctggctatattgcagccaaaaaaagcttttctggcaaaataggttttatagggggaatgaagggtaatatagtagatgcatttcgctatggttatgaatctggagcaaagtatgctaataaagatatagagattataagtgaatattccaattctttttccgatgttgatattggtagaaccatagctagtaaaatgtattctaaagggatagatgtaattcattttgcagctggtttagcaggaattggtgttattgagacagcaaaaaaccttggcgatggttactatgttattggagccgatcaggatcagtcatatcttgctcctaaaaattttattacttctgttataaaaaacattggggacgcattgtatttgattactggcgaatatattaaaaataataatgtttgggaaggtggaaaagttgttcaaatgggattaagagatggtgttattgggctgcctaatgcgaatgaatttgaatacataaaagttcttgagagaaaaataatcaataaagagatcattgttccttgcaatcaggaggaatatgaaatttttataaaacaaatattaaagtta

SEQ ID NO: 303 - DNA, 2352 bp, Borrelia burgdorferi sensu stricto
atgcttgacatcatcaaggaacttggttttaggtatgccactaagtttggatgcacaattagtatgagcgatattattgttcctgatgaaaaaagaacttatgtagaaagggccaataaagagattgctaagattcaaaatgattatgctaaaggtgttattactggcgaagagcgttataacaatgtagtttctgtttggttaaagaccaatgaagaacttactaataagatgatggaaattttaaagaaagatagagatggatttaatgttatatatatgatggcagattctggtgctaggggtagtaggaatcaaataagacagcttgctggtatgagaggattgatggcaaaaacttctggggatattattgagcttccaattatttctaactttaaagaaggtctttctgtgatagagttttttatatctacaaatggagcaagaaaaggtctagcagatactgctcttaagaccgctgatgctggatatttaactcgaagattagtagacattgctcaagatgttgttgttagaatagaggattgtggaactataaatggaataaaagttgagactgtaaaaaatggtgaagaaatattagaatctttgaaagaaaaagctgttgggagttattctattgaaagaataaaaaatccaattactggcgagattgttttagatgcaaatgaagaaatctcagaagctaaaatagaattattagagaaaattggtattgaaaaacttgttattagatctgttttaacgtgtgaagctgagcatggcgtttgtcaaaaatgttatggtagagacttttctaagaacaaacctgttaatattggggaggctgtgggaataattgctgctcagtccataggtcaaccgggtactcaattaaccatgagaacttttcatattggtggagttgctcaggctggcagtgaggatgataaaatatctttaaagaatgccttcatacttaatggcatagaaggttttaatgttagagttgataatggaattcttttcacaagaaaaggaactttaaaaataatcaatgttttttatgaggaaaaaattaagaacataaaagagattaaagttttagattctcaaagagtaataaaaggaattcctttgtttattgataaaaagggctcagagattctctcttcttacattggttatgttaaattaagagacgataattttttcatagtgtcagaagagcaagaagtttccttgaaagcgggtacaaagcttgaaatagaggttggtgattatgttgaatcaggcaaagttattggtacatttgatccatttgcagagcctattattgcagaggttaagggtaaaattaaatttaaggatattattttaggaactactcttaaagaggaaataaatactgaaacaggcaatgttgaaaaaagaattacagataatgtttttgaatctcttgatcctagaatttttattattgatagtagtggtatggaggttgcatcttatgtattaccaggtgatgcttatcttcaagttgaagatggccagagtattaacataggagatattattgcgaaactttctaaaggttctgaaaaaactcaagatattacagggggattgcctcgtgttaatgatctttttgagacaagaattcctaagaatttaactgaaatggctaaagtaagcggaattgtacaatttaaatcaattcaaaaaggtaaaaggcttattaatattttagatgagtatggggttgaacataagcattatattccagctggaaaacatcttttggttagagatggagatgttgtaaaagcaggagatatgctttgtgatggtagaattaatcctcatgatgtgcttgaaattttaggtgggattagtttacaagaatttctgttggcagaaattcaggatgtttatcgaaaacagggtgttagcattaatgacaaacatattggtgtgataatcaagcaaatgatgaaaaaagttaagattgttgcagttggtgatactaattttgtttatgggcaaaaggtagataagcacactttttatgagcaaaatagaaaagtaatcgaacaaggtggtgagccagcaatagcaagtccaattcttataggagtaactaaaacgtctcttaatatagattcttttatttccgcagcttctttccaggaaacaacaaaagtattaacagatgcttctattgctggaaaaatagatgatcttaggggattaaaagaaaatgttgtaattggacatttaattcctactggaactggtatgggtctttataaaaaaattaaagttagtgaaaatatcgattctgaagtt

SEQ ID NO: 304 - DNA, 3465 bp, Borrelia burgdorferi sensu stricto
atgataaaaagagttcatctgggacaaggaagagctgatgagattttagacctacctaacctgatagaaatacaattaaattcttatgaaaaatttttacaacttgataaattaaaaagtaaaaaacctttacttaatgagggccttgagtctgtttttagaaatatatttcccattaaaagtggaaatggtgatgttgctcttgagtatgaaagatactatatagaaaacgatgcccttaattttacagaaaaagaatgtaaaagaaagggtcaaagttatgaggctgttttaaaagtaagattgaatttgcaatttttgactactggggaaataaggcaaaaagacgtatacatgggaactattcctttaatgacagaaagaggcacttttattattaatggggctgagagggttgttgtttctcagattcacagatccccaggagttgttttttataaagaaaaagatttgtattctgctagaataattccttatcgtggttcttggttagaatttgagattgattcaaaaaaagattatctttatgtaaaaatagatagaaaaaaaagaatacttataactctttttttaagagctttagggtttgatacgagagaaaaaataatagaaactttttacaatattaaaaaaattaaagttgaagacggtacaaaaagagatcttccagggcaatatttagctaagagtattaacataagagagaatatgtattatcgtgcaggagataaaattactctgcaagatgttgaagattttttacaaaatggagtaaatgaaatagagcttgttgattttgatggttataatgatatttctggaaagcgctttgtaagttcgaatgttattctaaattgtcttgaaaaagaggatgctttctttgctttaaaggatggctctaaagagcttccaaaagaatcagttatgctagctgtttatggttctctttttcccggtgagccaatatcaattgataatgctgaaaacgatttaaaaaccatattcttttctgaaagaagatatgatcttggacgtgtggggcggtataaactttctaaaaaatttggatttgatgatttaactacatcggttttaactatggatgatattgttaacaccatatctcatcttttaagaatatatgaaggccatgatattcttgatgatattgaccatttaggaaatagaagggttcgttctgttggtgagcttcttactaatatatataaaggcgcgatgtcaagagttgaaaaaattgctaaagatagaatgtctaacaaggaagtttttaatctaaagcctcaagaattaataagcgttaagcctattgtatctgctgttaaagaattttttgcaaccagtcagctttcacagtttatggatcaggtcaatcctttggctgagcttactcacaaaaggcgtcttaatgctcttggaccaggaggactttcaagagatagggcaggatttgaagtaagagatgtgcattatactcattatggtagaatgtgtcctattgaaacccctgaagggccaaatattggacttattgtttctttggctacttattctagagttaatgattatggttttttagaaactccttataggaaagttgttaatggagtggtgacggaccaattagaatatttatctgctattgacgaagagaaaaagtgtattgctcaggctaatgctgcttttaattctaatggaaagtatcttgaagatttagtttctgttagaatttctggtgattatactacaacaagtcccacaaatatagactatatggacgtttctcctaggcagctaatttcagtatcttcggcgttaattccttttcttgagcacaatgatgcaaatcgagctcttatgggttctaatatgcaaagacaagcagtacctttgcttttccctaagcctcctattgttggtacgggtatggaaagcgttgttgcaaaggattcaggagtagttgttaaggctaaaagaagtggggaagttattcttgcaacaagtagtaagatagttgttaaaccttttgaggcagagaatgctaaagatttagatgaatatcatattgttaagtatgaaaggacaaatcaagacacttgttttaatcaatccgttttagttaaagagggtcaaaaagttgaaaggggcgagataatagctgacggtcctgctactagatatggagaacttgctcttggtaataatttattgctaggagttattccttggaatggatttaattatgaggatgctatattaatttctgatagaattgtaaaggaagatctttatacatctattcatatcaaagaatttagcatagaggtaagagaaactaaacttggtcctgagaaagttacaggagatatacctaatgttagtgaaaagatattaaataaattggatgaaaatgggattatacggataggaacttatgtaaagcccggtgatattctggttggtaaagttactccaaagtcagaaggagacattactcctgaatttagactgttaacttccatttttggagaaaaagcaaaagatgttaaaaataattcattaaaagttcctcatggtactgaaggtacagttattgatgttcaaaggattaccaaagaggatgttggtaatctttctcctggagttgaggagatacttaaagtttatgttgccaaaaaaaggaagcttaaagagggcgataaaatggctggacgacatggtaataagggtgttgttgcaaagattcttcctgttgaagatatgccttatcttgcagacggaacccctcttgatatatgcttaaatcctttgggagttccatctagaatgaatatcggacagttaatggaatctcaattaggccttgctggtaaatatcttggtgaatcttataatgttcctgtttttgaatctgctacaaatgaacaaattcaggaaaaattaaaaactgctggatttaatccaacttctaaagaaattttatatgatggttatacaggagagccgttcgaaaatgaagtaatggttggggtgatttacatgcttaaactacaccatcttgttgatgataaaatgcacgcaagatcaacaggcccatattctcttgtttctcagcaacctcttggaggaaaggctcaatttggtgggcaaagacttggagaaatggaggtttgggctcttgaagcttatggtgcggcgcacacccttcaagaacttttaacagttaaatctgatgatatgtcaggcagagttaaaatatatgaaaatatagtaaaaggcgttcctactaatgtatcagggattcctgagtcttttaatgtgctaatgcaagagcttagagggcttggacttgatttgtcaatttatgatgatgctgggaatcaggttcctttgacagaaaaagaagaagaattgattaataaaagc

SEQ ID NO: 305 - DNA, 1026 bp, Borrelia burgdorferi sensu stricto
atgttaataaaaaaaatttgcttttgtttgttacttttgcaagcaaaaataattctttcccaagatcaacagaacttagaatttaataatgaatatttttattttaattttcaatctgcttattatcctccccacgagctgggtacaaatggaagcggcttttcacaaagctttaaacatcctaacttccaaaatattgacccaagtttaaaaattccagtcaattattgggggggaataaaactaatatcatatttgggctactataaaaattttaaagccctaaacaatcccaattctatattttttaaaaataatggtatagatatagatttaaatatcggattgtctcctgtaattgtctcatttaaaagcacagtaagctttactcctattgcttttttaaatttatatgcatcaaatgaacttggcataggttggcaagcttttggatttaaaggagtaggcgtacacattgaaaatgggaaatattcaaatgctgttgaattttattcagaaataacagcggggggacgattccaatttgacttaaacgctatttttcaaggagaatggacacacattattacagttattggaaatgattttacatacttaatcaatccccatgcaaaaaaagatcaactttggaaatataaagcagatgatggtaaaaatataaatggcatgctaataaaaccttacgctcttttggcttacaaaatgccaatacctcttaacaccataggcctgctttatgaaggaaaaacacaaattggcaaagaaagaaacataagctcttggaaaaacaaaggctggggaagtgatattttttatcacaacatttctattgttgctaattttgaaattatcaaacctttaacacttggccttcaatttaaattatctacaaatcccacatacacaagtaacacagccggactggctgatatttcaaaaagaatagcaactggcaattcttatttttattacgattctattggaatgtctataacttataaatac

SEQ ID NO: 306 - DNA, 4482 bp, Borrelia burgdorferi sensu stricto
atgaaaaaagcaaactttttaagtactaattttttaattttacttttggtttgctttgtcaacgtcaatttattttctaaggatattttcaagtttaagcttgtagatcaattttttcctttttactacaagaataataaaggagaatatgaaggacttattttttctattttagataaatgggcaaaagataataatgctgatattatggttgagcatattgataatttaaatgaaagtgaaattgaagacgaagcaatatatttaggattaacttataatgtaaaattaaatgattttttttattttaaaagtgagcttgctaggagtatttcaattttattttttaaaaactctaataaaaaatataaaaatacccattcaacatttttatccaattttaatataggagttattaaaaatacaatatatgaagatatcttaaggttaaaaaacgttaacaccatttttttggctgataattctcaagagttagtattggccttaaaaaacgataaagttgattatatatatggtgattgcaagactttacattatattgcaaataactttttaagtgaagatcttgtgatttttaccggggatgttttttatagtatcaaaaatagagtggctattagtagaaatgctcctgagatagtaaagaatttgaatttagatttgttttcatatttaatgaaaatgcctgaggaacttgttttttcttttttagatagcaatgctaagggaagttttgttgatgttggtttatataatgattatcctcctttaagttttattaattcacagggaaaattgtctggcattttagtggatttgtggaatcttctctcaagacaacatatctttaaacctatttttaagggattttccaaagaggatattaagaaatcattagatggaaaatcagtaggtatttttggaggaattattagcaatgatagtgtgttggaaaatgttaattatgtagtaagtaagccaatatatcctcttaattttaaattttattctaaagacctaagcaatgatgctggtccaataaattctcagtttattgattttaattttaataatattcaattaaataagaataaagatattgttaataactttatagatattgttaataattcatatgggtttatagaaaattcaataacaacaaaatatttgttaaaattaaatggatataacggtagattaaaatcttacgattcgatttttaataaaaataggtttttagtattagccattgataataggatttataaggttattaaatatattctcaattctatatttgatgatatttcatttgaatctttgcttcaaatagataaaaattggttggataaagaagagattaatagttctagaataaatagttataaaattatgaataaggttaaatttaatatagaagaaaaaatttggttatcaaaaaataataaattaaatcttgctgttaaaaattggtatccaatagattatgttgaggcaaataattataaaggaataaatcaatttttgcttgataagattagaatgttttcaggtttgagatttaacataattaaagtacacagcagtttagatcttaaaaaattaatcaaatctggaaaaatcgatatgctaaatactaatgcaaccgattcaaatttagataatgttttcaacataaaattaaattctcgaattccactttatattttttcaaataagaaaagggtgcttccatctagatctttagaaaagtttgctatacttgattttttatatagtaaaaatttggcttctaatattaaatcaaagcttattctggtaagcagttttaatgaagcgttgcttcttctttataagggaaaggtagatgggattattagcgatgagtatacagctgctgctgtttttgaggaattaaatattgatgatgttgaaaaaattcctacttttagagatttggcttttgatttgagtcttgctatttataatcaagattatatcttgaaagaaattattcaaaaagttgttatgcgttcaaatgttgacagtcagatgtatttaaatgattggaaatttgatatttattataaatccagaagtatcaggtttaaaaatttcaaatttttagtgataacattcattatattttattttacttttttaggatttgtaattatatttatgttcagattatcatttgagcagaaaagaagatattcttttgtgatgaatgaaaaaaagattgcggaagccgctaatgctgctaaaaccatttttatagccaatgtcagtcatgatattcgtacccctattaacggaataatggcggctactgagcttttggatacaactattcttacagatgttcaaaaagattatgttaggatgataaattattcatctgattctttgctttctttaattgatgatatattgtatttgtctaaaatagatgtcaatgaattatatgttgagagtcaagagattgatttagagagtgaaatggaaatggttttaaaagcttttcaatctcaatgtgcaaagaaaaatattgatttattctcttattctaaatctatttttaataattatataaagggtgatattgtaaaaattaaacaagttttaattaatttaataggaaatgcttttaagtttacagatgatggtgttattgttttaaattatgaagaagtatgtagaacaagaactgatggtaatagggttttggttacagttgaatttaaggtaatagatacaggcaaagggattgaaaaagaaaatttttctaagatatttgaaatatttaaacaagaggatgattcttcttcaagggttcatgaaggtgcaggattgggattgtcaatatctagagagcttataagactaatgggtggtcttggtattgctgttgatagcaaggtgggagagggtacaactttttcatttatgttgccctttttattgggtagtgagcttaaaagtaaaaaattgtcaatcaatagatttcaatcagtaaatggtgacaataaagtattaaatgtgcttttaagtcaaaaatctattaaaatttttgagcactgttcgattttattgggatgctcttctaatgtgcgctatgtagcgtcttttgaggatgcttataaagtcttcaagaaatacccttcttataattttgtttatataaatgtaaataacgataatattcaagagggtattcgacttgccaataatattgaaagactaaattctgatgtacaaattatttttttattttattatttagataataaagctctaaaaaatttaaaatatggttatgttaaaaagcctttaatggggcttggtatatgctctattctttataaaaaagagtttaacccagaaatggattttgaggatttggttccaatagatagtgctttaaggataaaagagcccattaatgttttaatagctgaagataatcaggtaaatcaaaaagtgttgaaagatattcttgttgttataggcattaatgaaaattttattgatgttgtagatgatggagtaaaggctttaaaatctttaaaagataaaaaatatactatctcttttattgatatacgaatgccaagatatgatggattttcggtggctaaggaaattagaaaatttgaaaaggcaaagaatttaaagccttgtgttttggttgctgtaacagcgcatgctttgcaagagtataaagacaagtgtcttgcaagtggtatgaatgattatatctcaaaaccaatacacataagttcaattaaaactatattaaaaaaatacttacagtttgaagttgatgatattggggagaatgaaaatttgaatcaacttgttaagtttcctaatttagatgttaatagggctttaaaagaattaaatctttcatatgtatcatattctgaattatgtagagggcttgttgattttatctctattaatattattgatttggaaaaagcttttgatgaggaagatttgtctttaattaaggatatatctcattcaatatctggagctctttctaatatgcgtagcgaattgtataaagattttcaaaaaattgaaacaagtaaagattcaatttctgagttgaaaaaaatgtattcttttgtaaaagatgatttatttcaactaataagcgacataaaggaaaatattttgtttgagtctgagattgttagtgagaacaagctatattttaaaaataatgatcaatttttaaaccttctcaacaaacttttaattggtattaagactagaaagccaagagaatacaaagaaattcttgagagcattaataaatatgttttagacgataatattcaggtattatttagtgatcttcgcagaaatttaagattatatagatttgctgagagctctaagattcttgaagagattattgaaatgcttaataataagagatat

SEQ ID NO: 307 - DNA, 780 bp, Borrelia burgdorferi sensu stricto
atggatggagtttataaaatgatagatattcaacttttagatattgataacgatcagccaaggaaatttgttagccctgttgaattagaagagttaagcatttctataaaagaaaatggaattttgcaacctataattgtttgcaaagcaaatgagagatataaaataatagtaggagaaagaaggtttagggctgctaaacttattcagatgacgaatattcctgttatagaagttaacataaaagaatcttgtagagattttatgcctttggttgaaaatattcaaagagaaaattttacgcctgttgaggaagcctatgcctataaaaatgtaatgaataaatattctttaactcaaaaggatttgtctgaaaaaattggcaaaagtagagcctatatttcaaatttagttaggattttggatcttgaacaagaaatattaaatgcagtgcataggaaagaaatttcttttgggcatgctaaagttattttatccttaaaagacaagcaagacaggtataatctttatttaatgatagtgaaaaaaaagttttctgtaagagatgcagaaaaatatgtaaaaaatttttataaatccatagtaagaaaaagggaattagaacaagatccttttttaagcaatataaaagagtttttatttgataaaattcaaacaaaaatagatattaaaggaaatcaagataaaggaaaaatagagatagaatattttacagcgggtgatttaagaagaattgtttccttttttggtaatattagc

SEQ ID NO: 308 - DNA, 1917 bp, Borrelia burgdorferi sensu stricto
atgaatggaaggtttatgaattatgttgctagtaacattcaggtcttaaaaggacttgaggctgttaggaaaaggcctggcatgtatataggctcagtttctattaatggattgcaccatttggtttatgaggtggttgacaatagcattgatgaggctttagctgggttttgtgatagaatagatgttattatcaatttagataatactataactgtaattgataatgggagaggtattcctaccgatattcatgaagaggagggtattagtgcccttgaacttgttttaacaaaattacattctggtggtaagtttaataaaggcacgtataaagtttctgggggacttcatggcgttggaatttcggttgtaaatgctctatcttcgtttttagaggtttatgttaatagagatggaaaaatttttaggcaaactttttcaaaaggtattccgacttctaaagtagaagttgtgggggaatcttctgttacggggactaaggttacttttttggcggattctgaaatttttgaaactttagattataatttcgatgttcttgaaaaaaggcttaaagagcttgcttttttaaacgataaaatatacatttcaattgaagataaaagaattggtaaagaaaaatcttcaaaattttattttgagggtgggataaaatcttttgtagattatttaactaatgacagcaaagcttttcaatcagaaccttattatattgatggttttattaatgatgttattgttaatgtggggcttaaatggactgaaagctattctgacaacattctttcttttgttaataacattaatacaagagaagggggaactcatgttatgggatttagaagtggacttactaaggccatgaatgaagcttttaaaaattcaaaaataagtaaaaaagatattccaaatcttacaggagatgattttaaagaggggcttacagctgttatttctgtcaaagtaccagaacctcaatttgaaggtcaaacaaaaagtaagcttggtaattctgagataagaaaaatagttgaagttgttgtatatgaacatttattggaaattattaatttaaatcctttagagatagacactattcttggaaaagcaataaaagctgctcgtgctcgtgaagctgcaagaaaagcaagagaatcagaaagaaaaaaaaatgcatttgaaagcttggcattgcctggaaaattggctgattgtacttctaaaaatcctttggaaagagaaatctatattgtagaaggtgattctgctggaggaagtgctaaaatgggtagaaatagattttttcaggccattttgccactgtgggggaaaatgcttaatgttgagaaaacaagagaagataaggttatcaccaatgataagcttattcccataattgcatctcttggtgcaggagttggtaaaacttttgatattacaaaacttcgttatcacaagatcattattatggcagatgccgatgttgatggatctcatattagaactttgcttttagcttttttctttagatatatgagagatttaattgaaaatggatatatatatatagccatgcctcctctttataaaataaagtatgacaatcgtatttattatttttatgaagagaaagaaaaagaaaaatttttagattctattgaaactaaaaatcgcaatagtatttctcttcagagatataaagggcttggggagatgaatccaacgcagctttgggaaacaactatggatcctgctagaagaaaaatgagattgatgaatatagatgatgctattgaagctgaaaaaatttttgttactcttatgggagatttagttgagcccagaaaagaatttattgaacagaatgcacttaatgtaattaatcttgatgtg

SEQ ID NO: 309 - DNA, 1518 bp, Borrelia burgdorferi sensu stricto
atgataaatgcaaatatgaaaacaggacattttgaaatattggcaaaaaacattgaaattatctcaaagtgcaatgaattgccatttatgatagaagatgacaataatgcaagtgaaaactcaaaacttgaatacagatacttagatttaagaagagattccttgaaaaataaaattattttaagatgtcaggctactcatcttattagaaattttttaataaaaagaaaatttttagagctagaaactccaacttttgtaaaatcaacgccagaaggtgcaagagattttgtaatcccatcaaggattcacaaaggatctttttatgcactacctcaatctccacaactttacaaacaactcataatgatagcaggatttgacaaatactttcaaatagcccgctgctatagagacgaagattcaagaggggacagacaaccagagttcacccagctcgatcttgaaatgagctttgtcaaaaaagaaaatatttttaaattaatagaaaatatgctttttttaatattcaaaaattgcatcaatattaacctacctaaaaaattcaaaaaaataacatacaaaaaggcaatgaacaaatatggaagcgacaaaccagatactagatttgaacttgaattacaagatataagtcgtaatctaaaaaattcagaatttaatatattcaaagatactctaaaaaacaaaggttcaattaaaattttaatagtaaaagataaagctgacaagttttcaagagcaaaaataaacaatttagaagaaattgcaaagctttacaaaacacaagggctttattttacaaaaattgaaaacaataaattttccgggggaattgcaaaatttttaaaaacagaagaacaggaattaataaaaacctattctttagaaaataatgacataattttctttacagctaataataactgggaaactgcatgtaaagcaatgggtcaaattagaataaaaattgcaaatgatcttggactaatagatgaaaataaatttgaatttctatgggtctatgattttccactatttgaatatgacgaaaatacaaaaacctattcaccagctcaccacatgttctcgcttcccaaaaagcaatatattgctaatttagaaaaaaatccaaaaaaaactataggtgaaatttacgatcttgttttaaatggcgtagaacttggctcaggttcaattagaatacataacaaagagcttcaacaaagaattttcaaaataataggatttcaaaaagaaaaatcagaagatagatttggattttttctaaaagcattagaatatggagctcctaatcatggtggcattgctattggcattgatagactaataatgttgatgacaaaatcaacttcaataaaagatgtaatactgtttcctaaaaattcttttgcagcaagccctcttgataattccccctctaaaatctcaaatgaacaactcaaagaactgggaattaatattgttgatggtgacaat

SEQ ID NO: 310 - DNA, 687 bp, Borrelia burgdorferi sensu stricto
atgaaaacaatagagcacgaactttattatgaatttaggatagctgatgatgttaaaatgatttatactaaaaagccttttaatctaaaattaaaagaacttagtaatgataattttaactttgttcctaggtctaagaaaataaaatatttaaagcaattgcatacagatattatttataaagttgaagatgattttattaattttcaagaaggagatggtcttatatctagctctttagatgtagcccttgttgcttactttgcagattgtcttccaatatacttttatgattcggtgaaaaaaattatagggcttattcacagtggatacaaaggaagctttaatttgattattttaaaaatgttatttatgtttgaaaaaatgggatcagctttgaaggatttgaaaattgtttttgggccttataacagatcttgttgttatgaagtttctgaaattttcttaaaagaagtaagtaataaatttagcaaagatttattaaatgcttcttttgttacaagagatggtaaaatatactttgataatgctagttttaatttaaatttactttctagttttaatttaaatatttataattcaaagctttgtacgtattgtttgaaaaatctttattcttatagaagattaagagaaagtcaaagttatgctttaatttggagaatt

SEQ ID NO: 311 - DNA, 1326 bp, Borrelia burgdorferi sensu stricto
gtgcgatttaattttattaagtttttatatataggaggatggattatgcatagttatattgtagaaggcggctataagataggtggtcaaattacagctagtgggaataagaacgctgctttaccctgtattttggctgctttacttaccgatgaagaggttattttagaaaatattcctaatattaatgatgtaaaagttgttttagatattttaaatgacataggagcagatattgcaagagagggaaatactttaaaaataaaagttttaaatattgtgaaaacagaaatagattcttcttttacagatttaattagggcttccatacttttattagggccttttgtttctaggtttggaaaaatagatatggcgcttccaggaggagatgtgattggaaagaggaggcttgatactcatttttacgggctttgcaagctgggggccaagttaagcacaaaagatagaaggattgttttaaaggctaacaagcttgttggcgctgaaatgtttttagatgaagcttctgttacagccacagaaaatatcattatggctgcagttcttgctgaaggaaatactgttattatgaacgctgcttgtgagccacatgttcaagatttgtgtaatatgttaaattcaatgggcgctaatattttaggaattggttcaaatgttttagaaataaaaggtgtaaaaaaattaagtgggaccgtatttagaataggagccgatttcatgcaagttggttctttaattagccttgctgcattaacagggggtgagttggaaattaaaaaagcagatccccaacatttcagattaattaggcatgtatattcaagacttggcattaattttgaatatgacagggaaaatgtatatgtaagaaataaacaagaattaaaagttaagttagattttggtgggcacattccaaaaattgatgatggcccatggccagcctttccaacagaccttatgagtattattgtagttactgcaacgcaagtagaaggcacagttttagtttttgagaagatgtttgaatctaggatgttttttgtagataaattaataaaaatgggtgctcgaattgtgctttgtgatccacaccgcgtagtagttacgggcaaatcttctcttaaaggcaatgttttgtcttctccggatgtacgagcgggaatgtctcttcttattgctgcttttgttgctgaaggtcgcagcgagattcaaaatgtttatcaaattgaaagaggatacgaagatgtagttaacaaattgattaatttgggtgcaaaaatcaagaaagttaaaagtcaa

SEQ ID NO: 312 - DNA, 627 bp, Borrelia burgdorferi sensu stricto
atggaaagaaaagttttttctaaagatgggaaagagattggaactataaatttggatgatagagtttttaatatagaaattagtcatgggtctatttataatgctataaaaaacgagttgtctaatcttagggttggaacatcttcaactaaaaccagatcagaggttaggggtagttctaaaaagccttggaagcaaaaaggaaccggtagagctagggttggtacaaagcgaaatccagtttggattggcggaggtatagcattagggccaaagcctagggattatagctatagattgcctaaaaaggtaaaaaagcttgcatttaagtctgtattaagtttgcgtgctgctgatgaaaatagttttaaagttattgagaattttaatgttgaatctggaaaaacgaaagatcttgctttaataataaaaaattttgcaagttttaatggtaaggtggttattcttttgggcaatgatgatcagatgataaaaagggctggtaaaaatataagagatttaaagattttatcttttgataaacttagggttgttgatttattttatgctaagaatttaatagctctagaatccgctgttaacaagctcaatgagttttacattaaa

SEQ ID NO: 313 - DNA, 6498 bp, Borrelia burgdorferi sensu stricto
atgatagattttgcgactattttagttaacctttttttggtttcaatagttttatttgtttataggcaatacgataaacgttctagagcattagataaaattaaaaagttcgttgatcttacaaaggttaatcttgaagattttattgaagataagacaaaagagattaatgatcttgctgttgatatggaagcttatcaaagatctagtatagaaataataaaaaagattgaggaagttcagcaaaagattaaaaataaaagcaatgattttgcagaggttgaaaaaaagatagcctatcatgattctatgcttaaggatcttgatgaaatgacttttaaagttcaagagaatatacaaagattgcaagttgatgggaaaatagtagataaactttcaaaaactttaaaaggatttaatactcagattgattcggttgaatcaaatttgaattcagtgttagaaaaatttgacaaggctaataaagaaaatctcgagtctattaaaattgctagttgggaaaagtttgacactaatattaaggaacttgtttttaaaatagataatttaaataaagagattagtctttatgaaaaagatttagcaaatattgaagagagaaaaaatgatattttagttaagggtaatgagaaattagatttagaatttagcgattttcttgaaaaggtcgaatttaatattggcaaatacagcaaagagattgaaagttcttttaatttttatgaaaacaaatataagttaatagaaaattctatagagcttattatggagagtgtgaagaataaaattaatgaaaaagaagattttattttaaatagactgaatgaagaattgcaaaataaatttaaggatatcttagtatatgttgatgatcgctctaaggaaattaaagataagcttgaagataaattggttttggtggacaatgaaatttcttctatgagttcttcctttaaagacaatgtttattcaagaattaattcacttgaggagtcaatgcgaatagagatgggaaagtatgaagagcaagttgatgatgtttttgataaatttagatctcaagttgagttgaatcttaaaaatatttatgaggattatgaagataaaataagtcaagttgataataacattagagaaagggtagagcttagtttgttagatttgaattctaaaatggaaagtgttcagtctggtgctattgattttataaagaggcttgaagatgattctaatggaatatatcttgaatttaaaggtaagtttggggcagatattgaagtttttagtgaaagttttaaaggtgatattaatcaacttaagatgcagttagaatcccaactcttagatgttgattcaaatattcaagaaaagcttattaagcttaatgataatttgatttctaattttgaagaaattaatggtaggtttaataataattactcaaatttaaatgataatataaatgccaagtacacagctctttttgaatctttggattctagcagctctaaatttgaaaatcaaatggaatctaaatataagagctttacagataaattaacagcaggaatggatgaattttctttaatgtatggtgagaaatttgagacactctctcaagaggcgactaataattatcaagaatttcaagatttaaacaaaaaattagaaaatgaaattgaatctttttataatatgtttgaaaaaacccaagagactttaaaggtagattttaatactagtttaattaatattaaagatgaaattggtaaaaatatagtagagtttagggatcgttattacgatgaggtaaatatttttgttactcagctagaagaaagcaagcttcaatattcaaagtggcaaggtgaaatggattctaatttaaagaatattgaatctcaaataaataaaacaaatgaagaatttttaagtttaattcagattcaaaaagacaaaggaatagagcttagtgagagcgtttttaatgatctgtcagatcatattcaaaaaaaagctattgatatgcatggcagttggaaagatgagcttattgctttaaataaatctttgcttgatattaaggtttctagtgaagagctactttcatctgctactttaaaaatagaaagtttagaaaaagatgttaacgatagaatggaatatgttttattaaaaacaggcgatattgagagtttagtgatagaaaaatacaaagaattaaaagatatgtcatattcacaaagtgatgaggctatattaggaattaaagagtttattaatagacaaacagaaataattaaagataaaagcgtgtttatgcttgaggatttgaataaaaaatttgatgataagaataattttgttataagcaagattgaagaatgtgattataaattaaaagatttcaagattgaatcagaagatattttaaataattttaagtctgatcttaatgaatttattgagtcaaaactacaaattgtctctaatataaaatcggataatcaaaagcaaattgatgattttttagatagaatttctaaagatattttaaacaggaaagattcaattaacaatgaagtagatagcaagcttagtgattggcaaagtaaattaaatgaaataactgttaaaattgaaaatttattgtcttcaggtaaagttgatctggatttaatagattctgaggtgactacaaaaattaaagagcttaaattttctatagaaagccttgagagttattatcttgagaaaatagatgagtttagaaatcaaggtgccatatactctgatgagcttttgcaagacataatgaaccattttaataaagagactagagaacttgaagaaaatttatcaaaaaaatttgctgcggttttaaataattcagaggaatttgttaaagaggttgatagtttattgcaggacaaaagaaccgatattgcttcttttcaggctaacatagatattactcttgattctcttaatgtgaagtttaatgatataaacaaagaaattaatggaaaatacaatgaggtgatatctaattatagggggtattcagagaatatttctagtaaacttgaaaatgaaataatgcatgagattgaaaatctaagcagaagattgacagatagaatagatagtcttagtaaaggtatggatgaaaatcttcaaaaacttaaggaatcttttgatgtatcaaaatatcaagttgaaaaatttgaattgaaagttaaagatttaacagatgatggagaagcaaaaattaacaagcttgttaaagagatcgaacagtattataaatctagattagaagaagcaattgattatagaagaacgattgataacgatattatgcaagcaaaagagagatttggggagataacaaatgagcttaaaaataatattgagagtaagtctgagtttttaaacgatctttataaggaaagatttaaacttattgagagtaattttgaagagagatattctacatttttaattgaaagcgagggagctatttcaaaaattagagatgaaatctataaaacacttacaagtaatgatgaaaatttgcaaattaagatttctgaaatggatcaaaattttgagataatagagcaaagatcaaaagatattttagaatttgaaaaagaattgcaagataaaattaaagattgttacggttttataaattctcaatttggagagattaaggcaggtgttgaagagaatataaaaaatcattttgatgtttgtataaaaaaggtaaataccttgattgatgatgacattgtaaagtatgaaaatgaaattcacaagagaattgattctttaaaatcgattgagagtacttttgatagcatagagaaaaatttaaatgataaggtgagtgggtgtattgataaaatagctaatgattttaatcttaagtatattgaacttgaagaaaggtgtaatgaagggcaattaaatttagagaataaaattgacaacaaaattaaagccattgataatttagctttaagtcaatatgatggacttgagaaaaagtatgctgatatgtacgatgagttttcagagagattaaattcttatattgcaactttaagtgaagagtttaagagttcaaataaagagatgatttttgaacttgaatctcaactgaaaaatcttaaaaatcttgaatctgatttaaataatgttgaaaaggatgttattagattaaaagaagagtcttatcacaatgtttcatcacatcttaaattattagaagaagacttttttaaagatttaaaaattagaggcgaagagcttaaatattctttagaaaactttattgcctcatataatgataaaattcaaaatttagaatatgatttgtctaaaaatttggaaaacaaaacagaacttattcaaagtttccgtttagatattgaacaaaaaatgaaagatgataaagagaatttttatttagattttactaaagaattttcttctaaaaaaaaagatatgcagagcgagatagctttaatggaaaccaatattaccggaaaagtagatgaatttgttgattttgtaaataataagcaaagtattattgattcttggtttttgaatattaaagatgatgtaaaagattggcaagaaaaatcttatagcacaatagagaagagaataaatcttgctgagcttggaattaaatcatttgagaatgatatttttaatgttaagattggtttagaatcttttaaagatggttttgagattaaggctgaggagatttttagcaatttgcaaaacgaggctaaaaaaattgaacaatcagttcatcttgattttaaaaatattggcgaatcattaaatcttaaagttttagatcttgaaaaatttgttgattttaaattagaaaagatagatgaaaaggttaataaaaaaacagaagacatcttaattcaagcagaagtgaaatttttaactcagcaaaaggatcttgaagataagatctttgagcttaatcagaaattagagcatgaatttacaaccttgtcttctaatcttgataaagtaaggcgggaaatggttgatgtaatttctagtgataaagaaagctttgaagggcaaattgaattaattaataaaaatatttcagaattttctgagaaaattagtttatacagaaataatattgagacatcaattgagaatgaatataattcgttttctaaatctataaaatcagatctcggcttacttgaagatgagcttaaaaaaagtttaaaacattcaacatcagagattgaaaccataaagagtggtttgcaagaacaaattgataaatttgaggttgaatttaagaaaaatcataaagaattattaaaagaagttgataataatattttagaacttgaatctaaaatattaaattgtgatgttcaatttaacaaatttattagtgagattaaagacaatttagttgaatacaaatctgatttgagagcagaatttgaagatagttatgataaaataaattttcaaatcgaaaatcaaattgaaaattttaaaaaattagattctgaacttgaaaagaataattcaatatttttggaggcttattctcttaaggacaagttggaaaaattatgggaaactttaaaaaatgagatagggcttgctcaggaatataaaaataattttgaaaacgttaacaaagaattttataatattcaaaaagaaacattgggtattattgaaatttttaatgagctaaagttagaacaagaatcaattaaatctattaaaaatgattttaatagattttttgaattttactcttcatttgatagtagatataagagtttaattgaatcttatgatgaaatgcagatatataaagctaaaataaaagagatagctgacgagcagagaactattcttgataattatgaaagaattagcaataaagagagcatattaaagagtactatagagtctgttgataaaaattttgatttaataaatgaagtggagaaaagatttaataatttaagcaaagagagtgctaagattcaagacaatctcaaggatatggaaaatgttgtttcaagtctcttattaaacaaagggttgtcagaagaagtgttgattaatgctcaaaatttaaaggaaatgctattagatattgaaaataagttgaaaaatactttgactatgagagagagggtggtgaaatctgagacaaggttggagaatttaaatattgcagcagaagagagaataaaaactcttggtattcttgtcaaaactgattctaaatatcaagataatgttggtcttaataatgaaactgttaggaattctgtaataaaattaatgaggcagggatggagtgctgaagaaatttctagagctaccaaattatctattggggaagttgagcttattttagagcttggtataagtaataaaggtgat

SEQ ID NO: 314 - DNA, 1905 bp, Borrelia burgdorferi sensu stricto
atgggcaaaataataggtattgacctaggaacaacaaactcatgcgtagctataatggagcatggaaaaccagttgtaatacaaaattcagaagggggaagaactactccatctattgttgcttacacaaataaaggcgaaagacttgtggggcaagttgcaaaaaaccaaatggttacaaaccctgaaaacacaatttattctattaaaagatttatgggaagaagatttgaagaggttgcaagcgaaataaaaatggttccttataaaatagaaaaaggactaaatggcgatgcgcgagtaaacatttcaaatataaaaaagcaaatgtcaccgcctgagatctcagcagcaactcttacaaaaatgaaagaaacagcagaggcttatttaggtgaaaaagttacagaggctgttatcacagttcctgcttactttaatgatgctcaaagacaagccacaaaagatgctggaaaaatagcaggtcttgaggtaaaaagaattgttaacgagccaactgctgctgctcttgcttatggaattgaaaaaaaacacgaagagatcgttgctgtttacgatcttggtgggggaacatttgacatttcaatattggaacttggagatggtgtttttgaagtaaagtcaaccaacggagacacacatcttggtggtgacaattttgacgacgaaataataaaacatttaatttcagaattcaaaaaagaaagcgctattgatttatcaaacgacaaaatggctcttcaaagactcaaagaagcagctgaaaaagctaaaatagaactctcaggcgctcaagaagcttcaataaatcttccatttattacagcagatgcaaatggtccaaaacacttacaatatactctaacaagagcaaaattcgaacaaatggtagaccacttagttcaaaaaacaaaagaaccatgccttaaggctattaaagatgctgggcttaaagcttctgatattaatgaagtaatacttgtaggtggatcaacaagaattcctgctattcaaaaaattgtaaaagatatatttggacaagatcctaacaaaggagtaaatccagatgaagctgtagcaattggagctgctattcagggtggcattctaacaggagaaactaaagacatggtactccttgacgttactccactctcactaggaatagaaacactaggcggggttatgactaaacttattgaacgaaacaccacaattcctacaaaaaaaagtcaagtattctcaacagctgctgacaatcaaacctctgttgatattaaagtccttcaaggtgaacgtgaaatggcagcacaaaacagaatacttggtaattttatacttgatggaataccagcagcaccaagaggagtgcctcaaattgaagttagctttgacattgatgctaatggaatagttcatgtgtctgcaaaagatatgggaacgggcaaagaacaaaaaattagaattgaatcatcatcaggactctctgaatcagaaatagatcgaatggtaaaagatgcagaagctcatgcggaagaagataaaaaattaaaagaaaatattgaagcaaaaaatacagctaattctttaatttatcaaacagaaaaatcattaaaagaatattctgaaaaaatttcaagcgaagacaaagaagctattgaaagtaaaataaaagaattaaaagaaagtcttgaaaaagaagacatttcacttataaaatctagaacagaagaacttcaaaaagcttcttacaaaatagctgagatgatgtataaagattcttcccagcaaaatgcaaacagccaacaagaaaatggcccacaaagcaatacaagcgaagagggtaaagaggctgattatgaggttgttgacgaggataaaaaa

SEQ ID NO: 315 - DNA, 561 bp, Borrelia burgdorferi sensu stricto
atggaaaaaaaagaaactaaaagcgaatctgaaaaaaccaacaaacaagataataaaaatacaaaatctcaaaaaaaagaaaacttaaatttagtaaattctgataaaaaaattgctgaacttgaaaatgaaatctccaatcttaaagatttgtatttaagaaaacaagcagaatttgaaaacttcagaaaaagattagaaaaagaaaaagacaattttgttaaatttgcaaatgaaaccataatgaaagatgtcgttaattttcttgataacttagaacgagctattaactcttcaaaaaaatctaaagattttgataacttattaacaggaatcagtatgattgaaaatgaaatactatcaatctttgataaaaaatataatttaaaaaaatttggagaaaatggcgagaactttgatccaagtcgtcatgaagcaataagcattgaagagaaagagggtcttaaaaatccagaaatagtagaagtataccaaaaaggatattgctacaacgacagaatattaagaacagcgaaagttaaagttgctcaaagcaaaaat

SEQ ID NO: 316 - DNA, 858 bp, Borrelia burgdorferi sensu stricto
atgaaagatttgaatgaaaacaatgataataataaaggattttttgtagcattaacatcaattgcaacagtttgtatcataatatttcttgggacaattattttctttccaaacaaaaatttggcttcagacattgcagaaaaaaatattgttttagaagaagataaagatccaaacaccttagaaaaggttgaccaaaatgaaaaatctttaaaggtatctgaaactcaaaatgaaataattatagatttaacacaagatttaaataaagaaaaaaaacctacaaacaaaatacctaatactcagaaatcaaaaatcatcgaaaagcctcaacccacaactcaaaaaatatctaatacttctcagaaatcaaaaaccatcgaaaagcctcaacccacaactcaaaaaatatctaatacttctcagaaatcaaaaaccatcgaaaagcctcaacccacaactcaaaaaatatctaatacttctcagaaatcaaaaaccatcgaaaagcctcaacccacaactcaaaaaatatctaatacttctcagaaatcaaaaaccatcgaaaagcctcaacccatagcccaaaaaactttaaatactgataacatttatgatcctaatatagaatattacatacaatttgtatcactctcagacccaatcaatgcagacaactatattcaaaaattactcaaatataatataattgctagaatatattctgcaacagtagataataaagatatttacagagtaagatctggtccttataaaacaaaatcagaagcaaaagcagactttaaaaaaatagcaggaataggtgaatttaaagaaacttatatattacccgttaacaaa

SEQ ID NO: 317 - DNA, 1491 bp, Borrelia burgdorferi sensu stricto
atgaataaaacaaaaaatcgaagccttacgtattttataatactttcatgtatatcattatttggggctaataataatacaataagctactctagcattgaaattcctctagaagacttaagtgaagaatttaaaagttctgggaataaaagcgatcaaataaatacctcaaaacatttaaacaaaaacatagtttcttatgaagacccaaaaaagggtaaagatctaaaattgccagaaaatataagagacaaaaaactaccccaaaaaagaatggacgaaaatgatctaaaatctgtaattgaaaattatgaaaataaaattaaaaacatagaaaagcttttaaaaaccaaaaatcaaaaaacatcggaaaatgaaaataaaaaaatagaatcaatcgaaaaaaaagcaaaaaaatatgaaattttaaccaataaattaaaaaacgaaatagtagaaataaaaaagctccttaacaaaaaaatcaagcctaaagaagatgaaaattacgaaaaaataaatattgaaaacattgaagaagaaactgatgatgattttgaagacaattatgaatataatgatgaaattgaagmaacaaatgaggacaattacccttctaatgaaggaataataaacaatctaaaagaaaatcttaatgaaaacgaaaaatattatgctattaatgaaaaaaaaatcgatgaacttgaagacagaatcaacgagaatgaaaacactattttagacttgcaaagagaattaaggaattttaaaaaaaaagataactcagataaaaacttagaagaaattgaggaaaatttatcttcaataggaagaataattaatgatctaaaaagaaaaatcagcgcaaatgaagcaataaacaaagaaaatcaaaaaaaaataagaactgataaacacaaactcaaagaattagaagataaaataaaggaaaatgaagagactattttaaaacttcaaaaagaattaaacaattttaaaaaaaaagaaatttatcaaaaacccttaaatgaagaaactttcactccaagcattacaagtaaaaatgacgacttagaagaaaataagaaattaaaaaaggaatatttaaagcccatagaaaaaaaagaaagccgagatctagaagaaaatactaaaagcaccccaaaaacaactatgataaaaacagcagattttcaaatctaccctgacatatatcttaataattataaatttaaagaaaagggagatcaatttgcatttaaaaaagaaaacacatactatattgaaatagatcccactaacaatttaaatgaggctttaaaaaatcatgaaataatctcaaaatataaatttgaaaaatatttcattaaccctattctaaaaaataaagaagaattttttagaaacttaatagaagtcaaaaatatccacgaactaggaattatgtataaaaatctaaagcctgaatttaagcaaataaaaataattaaa

SEQ ID NO: 318 - DNA, 1950 bp, Borrelia burgdorferi sensu stricto
ttgattctaattttctattttaaacaaattgctttatttattatttttagattatgttatattataaaaaaagtaaagattaaattgaaaaggaaaagttgcatgaaaaaacaatttgatacagaagtaaatgatttgctttatttaatcatccactctctttactcccataaagaaatatttttaagagaattgatatcaaatgcgtctgacgccattgataaactcaagtttttaagcttgacaaacgaaaaattcaaaaacattgctctagaaccaaaaatagaaatatcgtttgatgataaaagcatcctaattaaagataatggaatcggaatggatgaacaagatttaactaatcatcttggcgtaattgcaaaatcaggaactaaagaatttattaacaatttaaaacaagatgaaaaaaaatctgcaagcctaattggccagtttggagttggattttacagcgcattcatagtatcagaaaaagtagaagttacatcaaaaaaagcattagaaagcgacgcatatatttggtctagcgacggcaaaacaggatatgaaatagaaaaagcaaaaaaagaagagtcaggtacagaaataaagttatatcttaataaagaaggccttgaatatgctaataaatggaaaattcaagaaattatcaaaaaatattcaaatcacataaattatcccatttatattaaatacagcgaacctataatgaaggacgggaaacaagagggaatagaagaaaaagaagaaaaattaaatgaaactactgctctttggacaaaaaataaaagcgaaattaaagcagaagaatacaatgaattttataaaaatacaacctttgattatgaaaatccattaatgcatattcatacaaaagccgaaggaaatttggaatatactaatttattttacgtcccaagcaaagctccctatgatttatattacccaaacactaagcctggggtaaagctatttataaatagaatctttattacagattctgaaggcagcttgcttccaaactatctaagatttataaaaggaattatagactgccaagatttgccactcaatgtaagtagagaaattttacagcaaaataaaattttgtctaaaataaaatcatcttctgtaaaaaaaatactaagcgagcttgaaaagctaagtaaaaaaaatcctgaaaaattttcagagttttctaaagaatttgggagatgcattaaagaaggtgtttattctgactttgaaaacagagaaaagcttatatcattaataaggtttaaatcctcaagtgtagatgggtttgtgtcttttaaagagtataaagaaagaatgaatgagagtcaaaaaagcatttactacataacaggcggtaaagaaaatatattaaaagaaaacccaatagtagctgcttataaagaaaaaggatttgaaatcttaatcatggacgatgaactcgatgaagctattttaaatctaattccagaatacgaaggattaaaactaaaggcaataaataaaaacgaaaccagcaatgaattaaaagatgaaaatttcaaaaaaattgaagaagaattcaaagatacccttacaaaagtaaaagaaatcctcaaggatcatataaaagaagtcaatctatcagcaacattgataaaagagccttcagcaataataattgatagcaatgatccaacttaccaaatgcaaaaaatcatgctgtcaatgggacaagaagtaaaagaaataaaaccaatacttgaattaaaccctaataataaaatagtccaaaatttaaaaaatctagagcctgaaaaattagaaaaaataagcattctcctttttgaagaagctatgttaacttcaggaatgcccagcaaaaatccaggaaaatttataaatataataaacgaatttatagaaaaagacttctta

SEQ ID NO: 319 - DNA, 687 bp, Borrelia burgdorferi sensu stricto
atgcttgaaataataagtcttggaggaggagtaataaattcaaaccaaatcaacatagaattcattaaaaactttaaaaactttgtttttaaatggctactagaaaatgaaaaaagaaaaatcattttaatagttggtggaggaagagttgcaagagaataccaagatgcttataaaaaaatcaatcctgattttaaagttcatgaacttgatgagattggaataatatcaacaagactaaacgcagaatttctgagtaaagtaatgaatcccttttgtaaagacaaaattgtcactaatcccttaaaaaatttttcttttaaaggaaaaatattaattgcttccggatggaaatcaggattctcaacagattacattgccgtaaaatttgcagaaaaatttaataaaaaagatatcataaatataacaaacgtaaatcaagtttatgataaagacccaaaaaaatttaaaaacgcaacagcttttaaaaaattaaattggaaacaattacaaaacattgtgggccaaaagtggaatccaggcttaaatttaccttttgacccaatagcaacaaaactctcttcaaaacttggacttaccctttacatagtaaatggaaataatattgaaaacttagaaaaagtttttaacaaaaataatgatttttttggcactattatagtaaaa

SEQ ID NO: 320 - DNA, 3483 bp, Borrelia burgdorferi sensu stricto
ttgttaaaaatcaagttttattttgataaaataattttaggtatgagttttaggtctaggtttattcatcttcatgttcattcagattattctcttttggatggagctgcaaaaatatcagatattatatcaaaagcaaaaaaatgcaatatgtcgcatattgcattaacagatcatggcaatctttttggagctattaaattttacaaagaagctaaaaaagcaggaattaagccaataattggcattgaagcctatatggcaaaaacttctaagtttttaaaaaaacaggatgatcttggaaaaatgtcttaccatttaattttgcttgccaagaatgagttgggttataaaaacctattaaagttaacaagtatttcttatcttgaagggttttattatcgtccaaggatagataaagatgaccttgaaaaatattcagaaggtttgatttgtacttcagcttgcattggggggctcattccaagacttattttggccaatagatttgaagatgccaagaatgaaattctttggtttaaaaaagtttttggcaatgatttttatcttgagcttcaaaggcatggtattaaagatcaagacattgtaaatgaaaggctggttaagtattctagagaacttggagttcctttaacagcagctaatgattctcattatgttaacagagaagatgcaactgctcaagacatcattgtttgtattggtactggtgctaagaaaagcgatgagaatagattaaaaatggaaaccaatgaattttatattaaatctcaagaggaaatgtgtgaactttttaatgatttgcccgaagctttagaaaatactgtaaggattgcagaaaagtgtgatgactttaaaataacttttccaggtcctattttgcctgattatcaaattcctgttgaatttaatactcttggtgaatatttggaacatctcacacttgaggggttgaaatttagatataaaaatttgacaagcaaaataaaagatagagctttttatgaattgagcgtaataattggaatgggctttgaaggctattttttgattgtttgggattttattaaatttgctcatgataacgatattcctgttggagctgggcgtggttctggtgctggttcaattgtggcttatgctcttaggattactgatattgatcctttaaagtataatttgctttttgagagatttttaaatcctgagcgtatttctatgcctgattttgatattgatttttgttttgaaggcagagatgagattataaaatatgttaccaacaaatatggagaagataaggtagctcaaataattacttttggaaccttaaagcctaaggctgtagttaaggatgtggctagggttttagatattccatttgctgaatcaaatgaacttactaagtttattcctgatggtcctaaagtttctttaaaagaggttttagatgacaattctttgaaagagtgttttactagcaagcctgtttataaagaattaatgaatgccgcattggttcttgagggaatgaatagacatgcttcaactcatgctgcaggaattgtgatttctaaaacccctttaaccgactatgtgcctctttataaggattataagcaaggttctgtttctactcaatacacaatggatttgcttgaagaatgtgggcttgttaagatggattttcttggtttgaaaacattgacgttaataaaaaatgcagaaaatcttattagaagtgtaaatccagattttaaaataaaaaatattccagataatgatgttaagacttttaatatgctaggagaaggaagaagtgcgtctgtttttcagtttgaatctgaaggaatgcagcaaattctaaaagacgcaaagcccgatagcattgaagatttaatagctttaaatgctctttataggccaggtcctatgcaatttattcctcaatttattgctgctaaaaaaggtgttaagagaattaaatatcctcatcccgatttaaaggaagttttaagaccaacttatggggttattgtttatcaagaacaagtaatggaagttgcaaaaataattggaggcttttctcttggcaaggccgatattttaagacgtgctatgggtaaaaagaaagaagacgagatgaatgaaatgaaagtcgacttcttaagaggcgctattgagaaaggatatgacaaagaaattgctagtgaaatttttgaacttttaaagcccttttctgggtatggatttaacaaatcgcatgcagcggcgtattctttaatagcatatcaaaccgcttatcttaaggctaattatcctgaatattttatggctgccaatttgaccaatgaaattaataataatgataagctttcttattacatcgaagagtcaaaagctataggcataaacgttctcaagcccgatataaatcgatcatttagggaatttcgtgtaactgattctgggatttcttatgggcttaatgggattaaaaatcttggaggaattgttgttgatttaataattgatgagagagaaaaaaacggcaaatatagttcttttgaagattttataagacgtgtagatgataaagtaattaataagaaatttttagaatctgcaataaaatctggactttttgatagtttggatcaaaatagaaaaactttatttgaaaatcttgatcatttgattgaagttgtttcagaagataaaaataataaaaaacttggtcaaaacagcttatttggtgctcttgaaagtcaagatccaattcagcaaagttttaattatcaaacttttaaagagtattcttattctgagcttttaggatttgaaaaagagcttttaggattttatgtgtcgggtcatcctcttgatccttataaaaaggcaattgacagtttttccagtttaaatgttttaacagatcttgctgccaaaaaagatagcattgttcaattttctggaattttaaattcagtaaaagttattcaaactaaaagaaataatgcaaaaatggctttcggcgttatagaagattttaaaggcgcaatagatattgtagtttttacagaaagctatgaaagatatagaaattttttacttgaaggcaatgttattggggttgtaggtaggcttacgtttaacagagataaattttcaattgtggttgaaaaagttgtaaatattgagagactttccgaatataaaataaataatattcatattaagtttttaaataataaattaaatgacctacaattacttaattctttaaaggaaagtataagtaattttgaggacaattctggattttcaaatgtttatttttatttaagggaaaatggtaaagatttgaaattaaaaatgaattcaattttaaattttgtgccagatgaagataagcttgataagttgagaaagtgtgtgatagttgaagatgtttgggttgat

SEQ ID NO: 321 - DNA, 795 bp, Borrelia burgdorferi sensu stricto
atgaataattgtttaataaagttttttatttttttattagttttttcaaacagttatgttgctttttctaaaaatgtcaatgttttaatagtaactgctatggactctgagtttgatcagataaataagcttatgtctaataaggaagaaatagttcttaaggagtatggtcttaataaaaagattttaaaggggaagttgtctaatcgcaatgttatggttattatttgtggggttggtaaggttaatgctggtgtgtggactagctacattttgtcaaaatacaacataagtcatgtcattaattctggcgttgctggtggcgttgttagtgctaaatacaaagatattaaagtgggagatgtggtggtgtcttcagaggttgcatatcatgatgttgatttgactaaatttggatacaaggtaggacagcttacaggaggattgcctcaaaaatttaatgccaataaaaatttaattaagaatgccatagaggccattaaatcaaaggttggaggttctaatgcatattcaggattaatagtttcaggagatcagtttattgatccaacttatattaacaaaattataggaaactttaaagatgtaatagctgttgagatggaaggtgcagcaatagggcatgtttctcatatgtttaatataccttttatagttattaggtcaatatctgacattgtaaataaagaagggaatgaggttgaatatagtaaattttctaaaatagctgctttcaattcagccaaagttgtacaagaaattttaagaaaactt

SEQ ID NO: 322 - DNA, 1854 bp, Borrelia burgdorferi sensu stricto
atgaaaagccatattttatataaattaatcatatttttaaccacatctgcagcaatatttgcagcagacgcattaaaggaaaaagatatatttaaaataaacccatggatgccaacatttggatttgaaaacacaagtgaattcagattagatatggacgagcttgttcctgggtttgaaaacaaaagcaaaattaccattaagcttaaaccatttgaagctaatcccgaattaggcaaagacgatccattctcagcttacattaaggtagaagatcttgcactaaaagcggaaggcaaaaaaggcgatcaatttaaaattgacgtgggagatattacagcccaaatcaatatgtacgatttttttattaaaataagtactatgacagattttgactttaataaagagtctttatttagttttgcacctatgactggatttaaaagcacttactatggattcccaagcaatgatagggcagtaagagggacaattcttgcaagaggtacttctaaaaacataggaacaattcagctgggatacaaactcccaaaactcgaccttacatttgcaatagggggaacaggcacgggtaacagaaatcaagagaatgacaaagacactccatacaataaaacatatcaaggaatcctttatggaattcaagcaacatggaaaccaataaaaaatctacttgatcaaaacgaagatactaaatctgtaattgcagaaacaccttttgaattaaattttggcttgtcaggagcctatggaaacgagacattcaataattcatcaataacatactctttaaaagataaatccgtagttggcaacgatttattgagcccaactttatcaaattctgcaattttagcatcttttggagctaaatataagcttggattaacaaaaataaacgataaaaatacctatcttattttgcaaatgggaactgattttggaatagatccttttgcaagcgatttttctatatttggacacatctcaaaagcagcgaatttcaaaaaagaaacaccctcagatcctaacaaaaaagctgaaatatttgatccaaatggcaatgctcttaatttcagcaaaaacacagaattgggcattgcattttcaacaggagcaagtataggttttgcttggaataaagataccggtgaaaaagaatcctgggcgattaaaggatctgattcctacagtacaagactctttggagaacaagacaaaaaatctggagttgcattgggaataagctatggacaaaacctttacagatctaaagatacagaaaaaagattaaaaaccatatctgaaaatgcatttcaaagcttaaatgttgaaatttcaagctatgaagacaacaaaaaagggattataaatggattaggatggataacatctatcggtctttacgatattttaagacaaaaatctgtagaaaactatcctacaacaatttcaagcaccactgaaaacaatcaaactgaacaaagttcaacaagcacaaagaccacaacccctaatctgacatttgaagatgcaatgaaactcggcttggccttatatcttgattatgcaattccaatagcatccatttcaacagaagcatatgtagtaccttacattggagcatacattttaggaccttctaataaactctcaagcgatgctacaaaaatttatttaaaaacaggacttagccttgaaaaactaataagatttacaacaatttctcttggatgggattcaaataacattatagaacttgctaataaaaacacaaataatgctgctattggaagtgctttcttgcaattcaaaatagcctacagcggaagc

SEQ ID NO: 323 - DNA, 1428 bp, Borrelia burgdorferi sensu stricto
atgagtattgtaattgattcttttaaagagatatcaaaaattccaagatgttcaaaaaatattaaaggaattattaattttattaagcagagagccaaaaaatttggttattcttttaaagaagatcgtgttggtaatattgtagtgcagataaaatcaaataataatattgatatgcatcctattattttacaatctcatgttgatatggtttgcgaaaagaatgaatccagtttgcataattttgaaacagatccaattgaaattgttgaagaggatggatatcttaaagcagtagggaccaccctcggagctgataatgggattggagtagctatgatgttggggattatgagtgaagccaataattttcctcatcccgatttagaacttctatttaccgttgatgaagaaataggtttaataggtgctcttggtcttgattctaatttatgtagtggtaaaagcctcattaatcttgatggagaggaagagggttattttttagttggttgtgcgggatcaagacttgtagaaattgttttttctcctaagtatagccttgtaacgaaaaaaacaaaggtagaaattttgtttaaagggcttaaaggtggccattctggggcagatattcatttagatttggcaaattctttaaaattaatgttttttgctctttttgaaattaaggcaaatcttaattttgagattgaaggcatttttggtggaaatagtagcaatgcaattccaattgaagccaaggctttaatctttatagatgataatgattatgatttattaaataaagagcttaaactgttcgtacttaaagttaaaagtgcatattctcttgaagatgaatttgatattattgttaataaaagagaattttcatcagttaaagttcttgatgaaaatagcaaaaataagcttttaaatatgggaatgggatttttacatggagttcaaaaagtagaaaattatgaaaataagcttataaagacctctttaaatttttcaagtcttttgagaatgcaagacgattatatttttacttttttaataagatctttattggatttagacaaagagtatgtttgcaatcatttacaatcaataagtgatttgtcgggagctaatttgcgtgtaatttatgatgatccttcttggcagcctgataagaatagcaatcttttaaaacatcttcaagaagtgtataaagagatgtatcttgaagatgctaatgtttccacaatacatgcaggtcttgaaacaggcataatatcttctagattgggaggtatagaatctgttacccttgggccttggattgaatggcctcatactactagggaaagagtaaatatttcttcaactattagagtttatgattttttgaaaaaaagcttagaaagatttcaaaaattt

SEQ ID NO: 324 - DNA, 1290 bp, Borrelia burgdorferi sensu stricto
atggcaagagtaaaaggtcaaaaagtaaaagagtgttctttttgtggacttagtgtcgctgagcttggtggtaatgttgttatatctaatggggtagcgatttgtccggaatgttctaaaatatgtcacaatctttttaaagaaaagttgtgtaagccgctagattctaagtccaacggtttgccaactcccaaacaacttaaagatcatttagacatgtatgttgttgggcaagaagatgctaaaaaagtcttatctgtggctgtttataatcattataaaagaatattgaaaaataataaatatgacaatggtattgagattgaaaaatctaatatacttttggttggtcctacaggcagtggtaaaactttgcttgcaaaaacgttggctgcagagatgaatgtgccatttgcaatagcagatgctacaactttgacagaagcaggatatgttggcgaggatgtagaaaatattttgcttaaattgatacatgctgctcatggggatgttagcttagctgaaaaagggattatctatatagacgagatagataaaattgctaaaaaaaatgaaaacgtctcaataacaagagatgtttctggggaaggggttcaacaggctttgttaaagataattgaaggcacggttgccaatgttcctccaagaggcggtagaaagcatccttatgaggatactattgaaattaatactcaaaatatactctttatatgtggcggtgcttttgttgggcttgaaaacattgttaagaatcgaataaataaaagttctattgggttttcagcaattgaaaaaaagaatataagagaagatacttcattaaagtatttagaaatggaagatttgattaaatttggcttaataccagaatttgttggcagacttcctgtgcattcgtatcttgaaaagttgaataaagaagatttgttgagaatattggttgatcctcaaaattctattgttaagcagtattatcatatgtttaaaatggacaatgttgaattggtatttgaaaaagatgctttagaatcaattgtagatgaagccattttaaaaaatactggagcaagaggtcttagatctattttagagggtcttcttaaagatgttatgttcgaggttccttctattagtaaggctaagaaggttgttgttacaaaagaatctgttttaaatgcagatgttaacccattaattttagtgggaaatgcaattaaaaaaccttgggcaaaagagttatatgaaatcaatcttaaatatgataaaaaa

SEQ ID NO: 325 - DNA, 2439 bp, Borrelia burgdorferi sensu stricto
atgcaattaaaaaaccttgggcaaaagagttatatgaaatcaatcttaaatatgataaaaaatagaaaagaagatcttccaattgttattttaaaagaaaatgttctttttcccaatattacattgtgggtaacctttgataatgaatatgtaattaattccatagcgcaatccatgttagaggaaagattgattttatttgcttattcaaatgagcctaattgtgatgaatctgataggggagtagttaaaaacctatgctctgtgggtacttattctaaacttattcaggttataaagattagtaaagacgtaataaaagttttagttgagtgtcaaagtagggttcttatagacagtgtttctaaaaaaaatgattatttgagagctaaagttacttttgtgcctgattctagtggattaaacagagagctttttacctattctaaatttttaaaagaaacctatgaagcttatagaaattccttatctttaaaatcttatgatgcggataatgaaccaattaattattttgagaatccaagtaagcttgtcgatattatagcttctaattcaaatttggaaaatagcataaaattagaacttttacaagagctaaatgttaaaaccagaatagaaaagttgattgttaatttaagcattgaaattgatcttttagatcttaaaaaagatattaattctaaagttagagctaagttggataaggggcaaagggattattttctttctgaacaagttaaagagatacaaaaaagattaggtaaagatgaaaacgattatattgatagattaaactctaaagatattccagaagatgttaaatctaagattgaaaaagaaatttctagattgtctaaaatgcagatgaattcacctgatgctaatattattagaagttatatagaattaatattagatcttccatggaatgaaaatactgttatgaaaaatcatttaagcgagattgaatttatcttaagaaattctcattatggtatggatgaagcaaaagaaaagataataaattttttggctgtttatcagattaattctaaggtcaaagctcctattttatgtcttgtggggcctcctggtattggcaaaacatctcttgtggagtctattgcaagatcactgtctagagaatttgttaaaatatctcttggtggcttaagagatgaggcagaaattagggggcatagaagaacttatgttggttctcttccgggtgtttttattagcgcaatgaaaagatcaggtaaatccaatcccgttattcttcttgatgaaatagataaaattaatagtagttataagggaaatcccgaatctgcccttttggaagttttagatccggagcaaaattataagtttatagatcattatttagaaattccttatgatctttccaatgttttatttgttacaacagccaattctcttaatggtatgtcaaagccgcttttagatagaatggaaataattaaggttgagggttattcttatattgaaaagttagagattgctaagatttttctgattccaagcataattaaagagagttttttggacaaagtttatataagaatagaagatgatgttatttttaatttgattagaaactatactatggaatctggtgtaagggggctaaagagagttttgactaatttgattaggagacttgtaagggagctgctttatgagtattctaaagatcaaatcatcaaaggcaacttttattcaccaagttctttgatacatgggaataattcgctttttactcatgatcctgatattccaggtatttataaaataatcaatattaataattattataattatgttgatactgaggataacttggatttaattaagattgattcttcggggtttgtttatgggcttgcttggacaaattatggtggtacagttcttcctgttgaggcaactaagtttgagaaaaagggagacattattctaacaggtagtcttggagctattatgaaagagagtgcacagcttgcatattctatagttaagacctattcttctaagcttaattttgatgtgaaggaaagtcctgaaattcatttgcactttccagaaggagcaacaccaaaagatgggccttctgcaggtattaccattgcaacggcaattgcttcgatattgtctgacaagaaagttcctttggatcttgcaatgactggtgaggtgactttaaagggctttgttcttcctgtgggcggcattaaagaaaaagttttagcagcctatagaaacggtataagtaaagttattttgcccaaagataataaaaaagattattctaagcttccagaagaagttaaggacaatatagatgttaagtttgtctccagcttggaagaagtttttgattatttgaatattatt

SEQ ID NO: 326 - DNA, 2091 bp, Borrelia burgdorferi sensu stricto
atgattacattgttcaaaatactggcattaaggaaaagtaaaactttttgtattttgcaaattatagatcttattatattattttattttttaataataggtcctgtaaatcttaatgccgattttgagtataaggttgtcaagggagatactcttttttcaattgcaattaaatataaagtcaaagtaagcgatcttaaaaggattaataaacttaatgttgacaatattaaggcgggtcaaatattaattattccaagtgattctaatttaggtcaaaacattacccacaaagtcaatcattcttttagtttgctagaatctagtaaagggggagttttttacaccgcaaaagaaggcgacaccattgagagcatctcaaagcttgttggactaagtcaagaagagataattgcttggaatgatttgcgttctaaagatcttaaggttggaatgaagcttgtattaaccgagcctgattttttaaagccttatatggttaggaaaggtgattcactttcaaaactttctcaggattttgatattagttctaaggatattttaaaatttaattttcttaatgatgataaattaaagattggccagcaactttttttaaagaaagccactaagaatgttaattttcattatgttaaaagaggggaaactcttggcagaatagcttatatttatggcgttactgctaaggatcttgtagcccttaatggcaatcgggctattaatcttaaagcaggttcattgttaaatgttttaaagattgtaaataatgatttagaaaaacctgttgagagagatttaaaaattgagaaaaaaatagataataagtttatctatcattcagttgctgtaggggagactttgtatagcattgccagacattacggtgttttaatcgaggatcttaaaaattggaataatttaagcagcaataatattatgcacgatcaaaaattgaaaatttttgataaaaaactttcaattgattcttctataattaaaactaaaaacgatttatatattaaaaaaaaggttgattctggctctaattcttctaataaagtgcaaacaatagttaatcttccctcaagtaaaaataaaaaactaaatttaaatacttttggaattactgccaatcaagatctttttgatattagctctttggttattttagactccaaaataccaatatttgaggttgttggtgatttctattattggtatagaccaagaaagataagtcagccaagtgagttttattcagaagattggcattctcctttgaattcttataaaaaggcaacccagcttttcaaaagttttgaaaagttggtaaattctaggtttaataaaggatcaagacttaaggataaattaataattcttgatccaggtcacggtggtcttgatcctggagctattgttaaatctagagatggtcttggaaatgaagtttttgttgttgaagatgaatatgtatatgatattgccttaaggctttatgtataccttaaagaagagggggccaatgttgaatttactattttagcccccgaccatttaattagaaatagtgtttttgctaacaatacttttgttaatgttaaaaacgaggtttacaatgattatgatctaaataaaaatgatactgttgattcttggataagcggcactccatcaggccttaaaaaaagattagtcgttgttaaaaacattgttaataaatataaacatattaaagataaggatatagccttttttagtttgcatgcggataatagtgttggagcgcctaagagtatggggttttattatcaaaaagatgacgataaaaaatatgatattcattcaaagtctgcagcagaaaaaattacagaaggaatgaaaagaagtttttatattaagggtcaaaatcttcatgttttaagaaataatatagtaatgactaagcttttagtagaagttagaaatttggcatttccagaggaagcttgggctattagatcttctaagcttagagatcaagattctaaaattcttgctaatgggattttaaaaatattggaaaataat

SEQ ID NO: 327 - DNA, 1686 bp, Borrelia burgdorferi sensu stricto
atgtttagaaaactaaaaaaattgaaaacttatattattattatttcaataactaaattttcagaagataacctgttattaataatatcaaatataaaatatttgattgaacacaaacagctagcttacaaaatacattggacatttccaatatacttttttgaaattctaagagaacatgaggaattaaataaatggctatttgaaagattcaaaaccaatacagatatatatatgcctggaacttacagtggaagccctcatgaatacatgctacacgatgaaatacatttagatttgtattgggcactaaaaaatccattcaaaagtggatacaaagacatatttcaaaatacgcctattatgttttatatatacaacatagaaaagtttagaaaaaaggtgactgagctttacagaaagcttaatttcaattatacagaaggaataaggcagagtaaaaataataaaaattatttaattttttataaaaataactgccaatatttatatgaagtacaaaaaatagattctccaaaaagcaacgtagaaactcttatttatttttatgagatcaaagaaacttatgataatcaagaactaaaaaattttttactttatttaaaagccctagaaaacaacttacacagcattaaaatacaaaatctagaaggatccaaacttaccaccgaactactagagattccaaaatttaactcccttaaagagcaagagccaataataaattttcaaaacaaaagactcaaagattatcaaatcaacgaaaaaagcttaagagaatttttaataaataaacaccaagatgaaatcattaaaaattcagaatcaattgtgcctaaaaatttagaatacaatatggaaggaaatttcacgctatctcacgatcaatacaacatcaaattcgaaaatggaaaattaaataaaataaaatttaaagataaaaaagttgaatttttaaacacatctagaacctattttaaagtttcatcaaaaaaagaactaataaaagaagcatctattgaaagttcattttcattctcaaatgaaaaaattttaggaataaaacaatatttagcttttaactctgccaaaaaatcaacaattgatttttttatagatgagactatctctagcttctttatatcgattaaaataaaatggccttctaaaatagatctagataaaaaaacattaaaaaaatgcaatcctgattatcttcttgaatattcagctcttgaaatacctgtttttgaaattacaaaaggcactaatttaaaaataacagcaaaatacagcgatcttgatacttatgaaaaaataataataactaaaaacaatcccaaaggctacattaatggcacagaatttttgatatctaaaggaaatgataaaaacagcaacttttttataagctttttaaatgttgaaaaacatatcattcatacaattaattataaaattgaaaaaataaattctaagaaatggttaattttaaatatagggggttcttataacacagttaagatccaagatgtaataaattactctcaaacactaaatttaatgatactaccattaaataataattttgataacaaaataaaactgaattcaaaaataaaaaatttaattttttatactaatataaaaaaatatgaaaataaa

SEQ ID NO: 328 - DNA, 1635 bp, Borrelia burgdorferi sensu stricto
atggctaaagacatatattttaatgaggatgctagaaaaagcttacttagtggcgttgaaaaattatccaatgctgtaaaagtaactcttgggccaaaagggagaaatgtccttattgataaaaagttcggctctccaacggttacaaaggatggggttagcgttgctcgtgagattgagcttgaaaatccgtttgaaaacatgggggcacagcttttaaaggaagttgctattaaaacaaatgatgttgctggtgatggaacaacaactgctactgttcttgcttatgctattgcaagagaaggccttaagaatgtgtcttcaggaatcaatcctattggaataaaaaagggaatagatcacgctgtaaatttggctgctgagaaaattcgtcagtctgcaaaaaagattacaacaaaagaagagattgcacaagtagcttcaatttctgctaataatgacagttatataggtgaaaaaattgctgaggcaatggataaagttggaaaagatggtgttataacagttgaagagtcaaaaacctttgatactacgatttcttatgttgagggtatgcaatttgatagaggatatctttctccttatttttctaccaataaagaaaatatgagtgttaattttgacgatgctttcatattgatatatgagaaaaagattagttctattaaagagcttttaccagttcttgagaaagttttagggacaaataaacctttattaattattgctgaggatattgagggggatgctcttgctgctcttgttttaaacagcgttagaggagctttaaaggtatgtgcaattaaatctcctggttttggtgatagacgaaaagcaatgcttgaggatattgcagtgcttaccggcggtgttttaatcagtgaggagctaggccttactcttgagacagttgaaattgagcaacttggacaggctaaaactattaaggttgataaagacaataccactattattaataccggcaataaagagcaaataaaggagcgttcagagcttattaaaaagcaaattgaagattcaacatctgaatatgataaagaaaaacttcaagagcgtcttgcaaaacttgttggcggagttgctgttattaatgttggagctgttactgaggtagagcttaaggagaaaaagcatagagttgaggacgctctttctgcaactcgtgctgctgttgaagagggtgttgtgcctggcggtggatcaactcttattgaagttgctatgtatttagatacaatagatacaagtaaattaagctatgaggaaaagcaaggttttgagattgtaaaaagaagtcttgaagagccaatgagacagattatttcaaatgctggttttgaaggatctatttatattcatcaaattaaaacagaaaaaaaagggcttgggtttgatgcttccagctttaagtgggtaaatatgattgagagtggaataattgatcctgctaaggttacaagaagcgcgcttcaaaatgctgcttcaattgctggacttttattaacaacagaatgtgcaatcacagatattaaagaagagaaaaatacttctggtggtggtggttatcctatggacccaggaatgggaatgatg

SEQ ID NO: 329 - DNA, 759 bp, Borrelia burgdorferi sensu stricto
atgctaggagattttatgtataaattagttttagtaagacacggagagagtgagtggaataaagaaaatctttttactggttggacagatgttaaactttctgacaagggtatcgatgaggctgttgaggcgggtttgcttctcaaacaagaaggctattcttttgatattgcttttagttctttgttgtcaagagctaatgacactttaaatattattttgcgagaattagggcaatcttatattagtgtaaaaaaaacctggagattaaatgaaaggcactatggagctttgcaaggtttaaataagtcagaaacagctgcaaaatatggggaagataaggttttaatttggagacgtagttatgatgtgcccccaatgtctttggatgagtctgatgatcgtcatcccataaaagatccaagatataaacatatccccaaaagggaacttccttcaacagagtgccttaaagatactgttgcaagagttattccttattggactgatgagattgcaaaagaagttcttgaaggtaaaaaagttattgttgctgctcacggtaattctttaagagcgcttgttaaatattttgacaatttaagtgaagaagatgttttaaagcttaacattcccacaggcattcctttagtttacgaattagataaagatttaaatcccattaaacattactatctaggtgatgagagcaaaattaaaaaggcaatggaatctgttgctagtcaaggaaagttaaag

SEQ ID NO: 330 - DNA, 1023 bp, Borrelia burgdorferi sensu stricto
atgaaaaggaaagctaaaagtattttattttttttattatccactgttctttttgctcaagagactgatggattagcagagggttctaaaagggcagagcctggagaattagttttagattttgccgagcttgcaagagatccaagttcaactagacttgatcttacaaattatgttgattatgtatattcgggcgcttctggtattgttaagccggaagatatggttgtagatcttgggataaataattggagcgttttacttactccttctgcaaggttgcaggcttacgttaaaaattcagttgttgcgcccgctgttgttaagagtgagtcaaaaaggtacgcaggtgatactattttaggggtaagagttttgtttccaagctattctcaatcatctgctatgattatgccaccatttaaaattcctttttattcaggggaaagtggcaatcaatttttaggcaaaggtcttattgataacattaaaaccatgaaagaaattaaggtatctgtttatagtttagggtatgagatagatcttgaggttttatttgaagatatgaatggcatggaatatgcttattctatgggtactttaaagtttaaagggtgggctgatttaatttggtcaaatcctaactatattcctaatatatcatccagaattattaaagacgatgttccaaattatcctcttgcttcaagtaaaatgagatttaaggcttttagagtttcaaagtcacacagttcaaaagagcaaaatttcatcttttatgttaaagatttaagagttctttatgataagttgagtgtttcaatagattctgatattgacagtgagtctgtatttaaagtttatgagactagcggaactgaatcccttcgtaaattaaaggcacacgaaacttttaaaagagttttaaagcttagagaaaaaatttctatgcctgaaggctctttccaaaactttgtagaaaagattgagagtgaaaaacctgaagaatcatctccgaaaaat

SEQ ID NO: 331 - DNA, 1398 bp, Borrelia burgdorferi sensu stricto
gtgcagataaaagaaatttattttggacccaaaattttagatgataaaaattctaattctaaattgaccaattttgattttaaagttgtttcttttgagcttgggtcggatcattatttagtagacattatgcaggttaaagaaattagaaaatctagtaattttacttatgttccaaatgccaaaaagtatgttgctgggcttgataatttacggggtgaaataattcctattatagatcttagaataatgtttaatttagaatttaataaaaaagatattgaagatattatggttttaaaaaacgaagaccttcttataggggtaattgttgataaaattaataatgttttttcaatagattctagccttattcaagatccacatccagttttatctcaggattctttaataaactatataaaaggcgttgtagattataacgaaaagctttatatacttcttaatgtttttaaaatttttaattatggtgaagaagaaaagttattaaaacctggtcaaaattttgttgaaaaaagcgactttgtaagcgattgtgataatttagatatactagaaaattctaagaatgatttttccaataaggtttcttcaaaaaatgatggtaacaatgaaaattcaactctaaacaatactgcagcttttaatttggaaaatattaaaaaaaatcttttgaaatactcgtttaatgcttctttggtaaatgatgtgtttttggaaaaagttggagtaaaatttaatatggttgatactgattacttgccttgcgatagttttttaaatgaattttattcaaaatcatcgggaaatttgtggggagctgattgtttggaagaatttaaaaatgaaattgttgagagtcgcttaagttttatgaataacttaaattctattttcaatgtattggaaattggttgtggtagtggaaaggagactatggctttagccaatgctttgtctgaatattatgtaaaaccttttaagttgacggccattgataatgatttatcaaaagttgttgaaacttctaggttggtgttttcagagtcagaaattggcattagtgaaatttatagtaggaattcttttgaacaaagtcccggagtttataaatttaagtcagaaatcctaagtaatgttttgtttgaatattccgatgctcttttttcagatttgcctgataatttgggaatggtttttttaaaagatgttttatgtttcttggatagtaaagatcagattttaattttaaatatcattgcttccaaagctattaaaggggctcttttggttttgggagataacgaagagcttaaaaataatgatgtttttataaaagagaaatccacaaaatattttaacttgtacaggaaagtc

SEQ ID NO: 332 - DNA, 2259 bp, Borrelia burgdorferi sensu stricto
atgttattgaagcttaaatacaggtttgttggatttttattattgtttttaatttttatactgctacttttttccacgatttttaattttgttttatgcggttatttagaagattattataagcagcttacaagggcgcaagtaagaagagcagctttttctttgcaatcttttttagacaccctgcatgtcataatcaatggtgcagcttctaatttggcacttgaaaccatatcagaatttgcaatgtctgagaatagaggaaaagatttctctgagtcggaattgatagatttaagaaaaaatccaaaatttgttattgactctgtaaaggtgagcaaaaaatatcgacaatacttatacaattttatggccaatcttaaaaatgataccctttttgaagaattcgctttttttgattttgaagggagagtaattgttagcacaagacatgagaataatatggattttggtcattctgaggctaataccaattattttaaaaaagctgttgaggattataggcaaaaccaattaaaatttataggttggtattcaaatctttctgaaggaatatccgcagaagttgctattaggtctaaacaaagcgaaaaaaaggcttttgcaataattgtacctgtatattccccagaagataaacttgtttgtgggtatttggccggatatttgcttaatgatattgtggcagatagttttgatagatttagattcggtttttataaaagaggcaattttatttatgtggatcccaacaatatagcagttaatccttttgaagaatataatgaaaccagcagggttagttctaaatttttgaatgttcttaaagatgttttctctaagcccccttttccatcaaacattgccagtgaagtgtcggtttacactattgatagaatacttttgtccgaaatgggagaagattgttattatgcaatgttgcccataagtagtaaattgggagaaaagagtggagtacttattgctaggcttccttataaggatatttacggagtaatatctagtctaagatttcagtatattttatattcagtcttaggcattatagcattaagtattgttctttcaattagaatagacaggattattagttttcgtttaaacgcaattagagttctagttcaagatatggttaagggcaatttagataaagattatgctcttgatgatgatgaaaatactcttgatgaacttggcatgttaagtcttcaggttgttaaaatgaaaaaagctatttctgtagcaatttctagtgttttgagaaatattagctatgtaaataaggcaagtttagaagttgccagttcaagtcaaaatttaagctctagtgcattgcaacaggcatctgctcttgaagaaatgtcagctaatgttgagcaaatagcctcaggtgtcaacatgagcgccaataattcttatgaaacagaacaaatagctttaaagacgaatgaaaattctcagataggtggtagggccgttgaagaatctgttattgctatgcaagacattgtggagaaagttagtgttattgaagagatagctagaaaaaccaatttacttgctttgaatgcggctattgaagctgcaagagcaggagatgagggaaagggatttgctgttgtggccagtgagattagaaagttggctgatttgagtaaaatttctgctcttgagattggagagttagttgaagataactctaaggtagcaactgaagcgggagtgatctttaaagaaatgctacccgaaattgaagaaacggctaatcttgttaagaagatttcagaaggtagctctaagcaaagcgatcagattgctcaatttaaaatggctttagatcaggttggagaagttgttcaatcttcagcttcaagcagtgagcagctttctagtatgtccgataaaatgttagaaaagtctaaggaacttagaaaatctgtattatttttcaaaattaaagattctaaaattgaaaatccagaaaatgatgattatgatttcaggttaatagattgtcctgaaaattcttttaaagatgaaaatcaaaatttgaaaagcaatggaatttctacttcaaatgccagtgggcataataattattctttagatattgagagcgaatcttctgtaagaactattaataagcgagttgatcctaaaaaagctatcgatattgctgataaggatttaaattttgatgatgatttttcagagttt

SEQ ID NO: 333 - DNA, 951 bp, Borrelia burgdorferi sensu stricto
atggatttgattagtttttctgtacccggaaatttacttttaatgggggagtatactattttagaggaaaagggattggggttggcaattgccatcaacaagagagcatttttttcttttaaaaagagcgattcttggcgcttttttagtaaaaagaaaaaaatagacgatttttctttaatagaaaatagaagcgattttgtttttaaaatgtttgcttacttgagtcaaaattgtttttttaatctagagaattttgcgtatgatgtatatattgatacaagtaattttttctttaatgatggaactaaaaagggatttggttcaagtgctgtcgttgctattggcatagtgtgtgggctttttttaattcacaatgctaccaatgttgttgagaaaggtgaaatttttaaatattgtttggaagcttacaggtattctcaaggaggaataggcagtggatatgatattgctactagtatttttgggggtgttattgagtttgaaggcggctttaatcctaaatgcaggcagctgggtgctgtagagtttaatgatttttatttgatgcagggtttgcaagcaattaaaactactacgtctatttgtgaatacaataaacatagaaattctattttagattttatattgaaatgcaatttggagatgaaaaagcttgttttaaatgctagcaattccaaatccgcattaatttctagtttaagaagggctaaagaattgggattggcaattggagaggcaataggagtttcggcagctttgccttcaagttttgatcaccttttaggtcaatgtgatttgattaaagctttgggagccggaaacgaaacttttttagtttacaggcccaatattgaagcttttaatttgtcaaaaattatttcaattgttttagagaatgaaggcattaagtttgaaagcgataaatgc

SEQ ID NO: 334 - DNA, 1569 bp, Borrelia burgdorferi sensu stricto
atgaagtatttacaaactgtagcttcaatgaaaagcaaatttgatattgtagctattgtggagcaatatattaagcttgttaaatcgggatctgcttacaaaggtctttgtccttttcatgctgagaagactccctctttttttgtaaatcctttgcaaggatatttttattgttttggatgcaaaaagggtggagatgttattggatttttaatggatatggaaaaaatcaattacaatgatgctcttaagattttatgcgaaaaatccggtattcattatgatgatttaaaaataagtcgaggaagtgaaaataaaaatgaaaataaagacatggtttcaaaaatttactctttgaattctcggttaattaataccattaaattttttttaagtaaaaacaaaaaagctttagattatgttttaaagagtagagcaatatctaaggaaattgttgatttatttgaacttggttatttgccatttaactttaaaaatggtttagagcttcatgattttttagtttcaaaaggatactcttctgaagtacttagaaaaagtggtttgttctcgaaaaccaatcccaaagtttctattttatttcaaagattaatttttccaattaaagactttaaaggaaacgttgttggttttggaggtcgagatttagatgggaaaggttctaagtatattaatttaggtgaaactgaagtttttaaaaaaagggagcttctttatggattttatgagggttttgaggagattaaatctacaaaatcagttatattggtagaagggtatatagatgttcttgctttttttacatctgggattaagagagccgtatctactcttggcactgctttttcaaaagagcatttagctttaattcaaagatatgctgatgagataatattttcttttgatggggatgatgctggactttctgcaactttaaaagcttatcaaatttgtttgccgtttaatatcaatgttagtgttgttcgaatggattttggtactgatcctgcagatgttcttaaaagtgagggtgtagactccttgcaaaaaattttaaataatagatgtgatgcttttgaatatcttttggatgtttattctaataaatataatttaaataaaactgtagatttaaatgccatgattaatttatttttaaatttgataaatttatcaaaagtagatactcagaaaaaaatttttttagacaagctaagcaataaacttggtattggtgtgacaactttattgaaagattattacagaataaaagaaagatttgtagttgacaataataaaagaaatttgtatgctcataatgatgattcttatgagaggtatctaatagtagctttgttgaaaaattttagttattttagcatagtaaggcgcaatattattgatagtgatttaattaatgtcgatgccagaaaagtttttatgtgctttgaaaatttatttgaaaataataaagatttttcattaatggatttaaaaaaaaatttaaaggatacctataaagttagtgaattttttttgaagaaattt

SEQ ID NO: 335 - DNA, 675 bp, Borrelia burgdorferi sensu stricto
atgaaaaagccaatttttaaagaaaataccatatattcaagcaaattcgatgacatctattacaatccaaagcagggaattgaagagagtttttatacatttattaaaggttgcaatttagatttagaattaaaaacaaaaaaaaatattttaatagcagagttgggatttggaacaggattaaactttatatgtcttttaaaattcataaaagaaaacaacataacctcaaaaattaattattattctatagaaaaatttccactcgaaaaaaaaacaataatgcaaatttcaaagttctttgctaaagaaaccgcttattttaaattaatgttgaaaaattattctaaaattccaaaaaaaaatttaaaactaaaaataacagaaaatgttaatttaaaaattttaattggagacgccaaaataaaaatcaaagaaattcctgaaaatgtagaatactggtttttagacggatttaatcccaaaaaaaatcctgaaatgtggagcaatgaaatatttaatttaatttctgagaaaagcagtccgaaatgcaagctttcaacattttcctctgcaagaattgtaaaagatggcctaaaacttgctaattttaaatacattcacatagaaaaaggatttggaaataaaagacatatgataaaagctcaaaaaaat

SEQ ID NO: 336 - DNA, 2100 bp, Borrelia burgdorferi sensu stricto
atgaaaaaaatgttactaatctttagtttttttcttattttcttgaatggatttcctgttagtgcaagagaagttgatagggaaaaattaaaggactttgttaatatggatcttgagtttgtaaattataaaggcccttatgattctacaaatacatatgaacaaatagtgggtattggggagtttttagcaagaccgttgaccaattccaatagcaactcaagttattatggtaaatattttattaatagatttattgatgatcaagataaaaaagcaagcgttgatgttttttctattggtagtaagtcagagcttgacagtatattgaatttaagaagaattcttacagggtatttaataaagtctttcgattatgacaggtctagtgcagaattaattgctaaggttattacaatatataatgctgtttatagaggagatttggattattataaagggttttatattgaggctgctttaaagtctttaagtaaagaaaatgcaggtctttctagggtttatagtcagtgggctggaaagacacaaatatttattcctcttaaaaaggatattttgtctggaaatattgagtctgacattgatattgacagtttagttacagataaggtggtggcagctcttttaagtgaaaatgaagcaggtgttaactttgcaagagatattacagatattcaaggcgaaactcataaggcagatcaagataaaattgatattgaattagacaatattcatgaaagtgattccaatataacagaaactattgaaaatttaagggatcagcttgaaaaagctacagatgaagagcataaaaaagagattgaaagtcaggttgatgctaaaaagaaacaaaaggaagagctagataaaaaggcaataaatcttgataaagctcagcaaaaattagattctgctgaagataatttagatgttcaaagaaatactgttagagagaaaattcaagaggatattaacgaaattaacaaggaaaagaatttaccaaagcctggtgatgtaagttctcctaaagttgataagcaactacaaataaaagagagcctggaagatttgcaggagcagcttaaagaaactggtgatgaaaatcagaaaagagaaattgaaaagcaaattgaaatcaaaaaaagtgatgaaaagcttttaaaaagtaaagatgataaagcaagtaaagatggtaaagccttggatcttgatcgagaattaaattctaaagcttctagcaaagaaaaaagtaaagccaaggaagaagaaataaccaagggtaagtcacagaaaagcttaggcgatttgaataatgatgaaaatcttatgatgccagaagatcaaaaattacctgaggttaaaaaattagatagcaaaaaagaatttaaacctgtttctgaggttgagaaattagataagattttcaagtctaataacaatgttggagaattatcaccgttagataaatcttcttataaagacattgattcaaaagaggagacagttaataaagatgttaatttgcaaaagactaagcctcaggttaaagaccaagttacttctttgaatgaagatttgactactatgtctatagattccagtagtcctgtatttttagaggttattgatccaattacaaatttaggaactcttcaacttattgatttaaatactggtgttaggcttaaagaaagcactcagcaaggcattcagcggtatggaatttatgaacgtgaaaaagatttggttgttattaaaatggattcaggaaaagctaagcttcagatacttgataaacttgaaaatttaaaagtggtatcagagtctaattttgagattaataaaaattcatctctttatgttgattctaaaatgattttagtagctgttagggataaagatagtagtaatgattggagattggccaaattttctcctaaaaatttagatgagtttattctttcagagaataaaattatgccttttactagcttttctgtgagaaaaaattttatttatttgcaagatgagtttaaaagtctagttattttagatgtaaatactttaaagaaagttaag

SEQ ID NO: 337 - DNA, 1017 bp, Borrelia burgdorferi sensu stricto
gtgtttatgacaaaaccaaaaatattctcaatcaataaagaaaaaataaaaatattgataatagtagtgttaacatctacattcttattgggaataattttttcaaatgaaaataaagtagcaaggatccttgaagaaaaattttttgattttgactttaatttaatttctaaaattgaaacagagcttgaaggaacgctaacaaaacttggcaaagattggattttaacatacaataaacaaaatattcctgttgataacaaaaaagtcaactctctaatcaaagcattagacgagcttcaaaaaaacaagcttgtaagtagagatcaaaaaaaacacaaggaactaggaattggagaaaatccaagctttaaattatttgacaataataataagctgttaacagaaatttttgttggaaaatcaggagaaggcgattcaagactggcatacattaaaggtagtgacgaaaatgtttacttaacaaaaaacattttcttatcatacaaaggaaattcttacaatacattttcagatactacattgttccaagaaaaaaacacaaaattagaaaatttatcattcaaaataataagaaaattaaacaaggaaaatgaaaataacataaataataactatgagattatcagtaaagatggcctttattttttaaataaccaaaaaatgacaaaagaaaggcctttaaatattattgctgaatttaaagctgacggacttgaaattgataaatctaaaatagatgattataatcttcaatacaaaattgaagtcaaatggagcaataaaagtgtcaataatattgaagtttattttaataaaaacgaagaaaatgacaaagacatattaatcaaaaaagataaagatgaatattactacacgactagcaaatggactttttttgatgtattcgacttagaaaaaaaattaacagaaaaagatgatatttctagcaacgataatcaagaagatcatcatgaacatcacaacaatgcagat

SEQ ID NO: 338 - DNA, 927 bp, Borrelia burgdorferi sensu stricto
atgataaatgtagaaaaagttactaaaatgtatgggccatttacagcactatttaatgttagctttaaggttgaagaaggcgaagtacttggtatacttggcccaaacggagccggaaagtccacattaatcaaaatcttaacatcatttcattatccaagcaaaggtaatgtaaaaatttttggaaaagacattgtagagcattcgaaagaaatactacagcaaataggatatgttcctgaaaaactagctctttatccagagctttctgttaaagaatatttaaagtttatatcagaaataaaaggtgttaaaaaattaaaaaaagaaattgacagagtaataagcatattcaaattaaaagaggttgaagataagctgatttctcaactttcaaaaggatttagacaaagagtaggaatagctggcgctttaataaacaatcctaaacttgtaatacttgatgagccaacaaacggtcttgatccaaatcaaataattgaatttaaagaatttttaagagaacttgcaaaagaaagtacaatattattctcttcgcacatactaagcgaagtagaatctatttgtaaaagaataattattgtcaacaacggagtaattgttgctgatgacacaaaagaaaatattattaaaaataaacttaaagagattgaaatagaattaatagtttcaaaaaaatctgaaaatgagaaaaaaattttcaacagcaaaaatgatattttttcattaataaagcttgaagaacacgaaaaagacttaaatatttcattaaaactatctcaaggcaaaacagaagaagatctctttagctacatagtaaaaaataatataatcttaaaagcaatgattccaaaacatgaaagccttgaaaagatatttagcaaattaaccaaggagagagaaaaa

SEQ ID NO: 339 - DNA, 372 bp, Borrelia burgdorferi sensu stricto
ttggacttgcaaataataacaaactgtaataaactgtctctcaacatggagctaaacgaataccaagaaaaagcaaaaaaaactgctaaatacaaaaataaaaaagaagaattaattttaacaacacttggtcttgctggtgaaactggagaagttgttgaaaaaataaaaaaattgggaagagataaaaattacattattgatgatgagtatttaatatcaattaaaaaagagcttggggacgtattatggtacttgtcaagtttaagcaataatttaggcattacgcttgaagatgttgccctcacaaacctaaaaaaaatacaaaaacgacatgaaaatggaacaataaatggcgaaggcgatgacaga

SEQ ID NO: 340 - DNA, 1044 bp, Borrelia burgdorferi sensu stricto
atgacaatgcttccaaaaattgcaaaagagataataaacgaatatgatcaaaaaatactgccaaatgcaattcttttactaggagaaaaattttcttcaaaaaagattagcgcaattgagcttgcaaaaaaaatattaaacggaaaaaacttaacaaaccctaatttgctcattttctcaaatcttgacacagtagaagcaaaagcacatctttctacaaattcgcaaaagatagcaaataaatacctagaatatattaaaactgtaatttttaccaaatgttatttcagcaatgaaaaaaatttaaaaaaaatagaaaaaaatatcaactacattaattctgtttattatgaaaaagaatacaatgaaaacataaaaaatgagcttataaaaaatatagaaaatataaacaaagaattaaatcatagcattactgtttatgatgtaaaaaaaattcaaacttggattttttctgaaaaagaaaaaccaaaggtaatctacataaacgaaatcgaaaatttatcatttaatgtccataactcacttttaaaaatattggaagagcctccctcaaatatttactttatcttggcagcaagaaataaaaacaaaataccaaaaacaatactttcaagacttagagtctacaatttcgcaaaactagacagaagcttagaaattcaaagatttaaagaaagctttctaataaataaagatataacaattgaagagtatttcgcctcattttacaaagaagaaagcaaaaaaataaaaaaagaattggcaaaaattctaaatataataaaagaaaaaaaatccatatttaatcttgaagaagtcgactttataaaagatgagcaaagctttaaaatatttttaaacgaacttacaattaacattagaaaagattttttagaaaacaaaatagatattaatcaatatctaaagtacacagagcatttgaaaaatatttacaaatatcgcccctataatcaaaataaaaaattaataatagaaaacttaatgctaaattatgaggagata

SEQ ID NO: 341 - DNA, 1005 bp, Borrelia burgdorferi sensu stricto
atgaacaaactaatgttgatgttaattacatttgcaacgagtctattagcccaaacaaacaaagcttcaacaggactaaaaacagatcaatcatttaacaatagcctatctgaaagcgtaaaattaaaagaaattgcggatatttatcccacaaatacaaattttttaacaggtattggaatagtagcgggacttgctggaaaaggagactctataaaacaaaaagaccttataattaaaattttagaagaaaacaatataataaatgaaataggctctaataacatagaaagtaaaaatattgcactagtaaatgtcagtctccaagtaaaaggtaatacaatcaaaggttcaaaacataaagcttgcgttgcatcaatactggactcaaaagatttaacaaatggaatacttttaaaaacaaatcttaaaaataaagagggggaaataatagcaattgcatcaggaattacacagcccaataataaattaaaaggatctggatatactatagatagtgtaataataaatgagaatcaaaatattaaccacagttataatataattcttaaaaaaggaaattatacattaataaatagaattcataaaatattaacctctaaaaaaatcaacaacaaaattaaatcagacagcacaatagaaatagaagcaaaaaacataagcctattagaagagattgaaaatattaaaatagaaaccaaccccaagatattaatagacaaaaaaaatggtattattttagcaagtgaaaatgcaaaaataggaacttttacattttccattgaaaaagacaatcaaaacatttttttaagtaaaaataacaaaacaacaattcaagtaaactcaatgaaattaaatgaatttatattaaaaaattccaacaatcttagcaataaagaattaattcaaataattcaagctgcgcaaaaaattaataaattaaatggggaacttatcttggaggaaattgatggaaaccaaaat

SEQ ID NO: 342 - DNA, 1182 bp, Borrelia burgdorferi sensu stricto
ttgagaaaggatttaatttttttatttttaattgttttaataatagcaagtgtagtaattttttttattagaagttcgaaaaaagagttggtttacttcgagcttaatacaaagagtaatattagttttttgtttctaatagaagatcttaacaaaaaccttgtaagtatgcaagaaatttttattaatatgaaaacaggaaatattgggttttttgatattccaattcatactggatatgaagatttaaaagggaatatatcttggtttaaagatctttataaaaaaaattcttttaataaatttttatctaaaatttatacacaattatctcatgaatcagattattatattcgttttcaaaaagaaaattttgttaggcttattgattacttagggggagttagacttcttgttaaaaacccagtgaaagtttatagtttcgaggattctattttaataccctctggcacttctaattttgatggtgataaggcttatgattatttgagatattttaatgatgttaatcagtttgaagagagagttgaattttttaaagaattttttaaaagacttctttttcaaatttcagattttggcattgaaaatgacagtttttttaaaatatattccatgttagatactaacctttcagaggttgtttttaagtatattgttaaaaattataaaataaataatgataaaattatttctattaatattaaaggacaagaagagatttttaaggataatgataataatttgataaaggtggtttttccttattatgggggtgctattttaaaagaatcggtggataaattaaacaaagagttggttaatgaaggtgcagaagagatagtaaagattgttgttttaaatggaacaaaagttgttgggcttgcaaaaaaaacagcaaatatttttaattctttaaaatttaaagttttaaaatttggtaatgcagataaaaattcttataaaaataccctgattataaataattcggataatttagaaatggctgttagggttggagaggtaattaaaacttcaaatattaagccaatttctgaggttcaagctaaaagattgttagagcttgataatcttgatattaatcctgatgtaatagttattttaggagatgattttgatggaaggtatgttaaaagtaaa

SEQ ID NO: 343 - DNA, 1917 bp, Borrelia burgdorferi sensu stricto
atgaatggcaataataatatgaataacaatggaaaatctaacaacaaaaaaaagaataaaaattggattttaggacttgttgttgtttttctaatttcagcaatatttatgtcatattttataagggggggggaaagctataaaaatgttccttatagcacttttcagagttatttagacaatggtctagttgagtctgtagtaataattgataaaaatttgattcaatttgtcgtcaagggttctaactttgcaaagtcttatttttctaccagcattccctatcttgatataaatttactttcagaactaaaaaataaaaaagttgagcttagctcagggaaaagtcaagcttctctgattggggttttattacaaactttgccatggattttgttttttattttctttttctttatatttcgtcaaactcaaggtggcggtgggaaggtttttacatttgggaaaagtaatgctcaaaagtatgaagctggaaagaataaaatcacctttaaagatgtggctggtcaagaagaggttaagcaagagcttcgagaagttgtcgaatttcttaaaaatccaaaaaaatttgaaaaaataggtgcaaaaatccccaaaggagtgcttttagtgggctctccgggtactggcaagactttgcttgccaaagccgttgccggtgaggctggggttagtttctttcacatgtcaggctcagattttgttgaaatgtttgttggggttggagcaagtcgtgttagagatttatttgataatgctagaaaaaattctccatgtattatttttattgatgagcttgatgctgttggtcgaagtcgtggtgcggggcttggcggtggtcatgatgaaagagagcaaactcttaatcagctgttagttgaaatggatggatttggaacgcataccaatgtaattgttatggccgctacaaatcgtcccgatgttcttgactctgctttgcttaggcctggacgatttgacaggcaagtaacagtttctttgcctgatattaaggaaagagaggcaatattaaatattcattctttaaaaacgaagctttcaaaagatattaatttacaagtaatagcaagagctactcctggagctagtggtgctgatcttgcaaatttaattaatgaaggagccttaatagctgcaaggaataatcaagatgaaattttaatgaaggatatggaagaagccagagataaaatattgatgggagttgcaaaaaaatccatgactattactgataggcaaaagcttgagacggcttatcatgaggcaggccatgctttgcttcactattatcttgaacatgctgatccacttcacaaagttaccattattccaaggggcagggcacttggtgttgcattttctcttccaagggaagatagactttcaataaacaaacaccaaattcttgacaaaataaagatatgctatggtggttatgctagcgagcaaataaatttgggtgttacaacagcgggtgttcaaaatgatttaatgcaagctactagtttggctaaaaaaatggttacggagtggggaatgggtgaagaagttggtccaatatttttagtagacgatgaagcacctattttccttccgaaagagttttcaaaggctaaagcttattctgagaacactgccgataaagttgacagagaggtaaaaagaatacttgaagaatgtttaaaagaggcatcggatattcttttaaagcataaggatcaacttgttaagcttgcaaaagaacttgttttaaaagaaactttgacagacaaagaagtgagagagcttttgggttttgaagctaataaggatgaatacgatttattttcatcagactctactacaaaagaagtaaagggggaggatgtaaaaggt

SEQ ID NO: 344 - DNA, 4395 bp, Borrelia burgdorferi sensu stricto
atgaatttgttgtttttgagaagtaagacatttatattgttgattttgccattttttatttttgttttaataattttttccattaatctatttgttcaagctcaaatttattctgcaaagttttttgctataaaatatcttgaatcaaaatttggctttaagattaaatatgataaaatttcaccgtatttcttatcatcaatcaagatagacggtttagagttaagcttggatggaaaagataaaatattaatagatattgttaggatagatttaaatctgtttaaattaattttgggtgatgaaaatattattttaaatgtttatgttaaaggaagtaatttcaattttgatataaacgactttagtttatctggcgatttaaatcctagcaatgcctattctgacaatgaaaatacagtttttaataaaattttaaactacctttatagattaaatattaatttagaaaatatcaatattaatatcaagcttaatgataatagttggcttaattttcaagttaaaaatttttccttaagtaccgtagatgaagattttttatttagctctgtagttgattttagtgctgttaaaaatttagaaattaatttaccctttgaaagagttgatgatggaattttggattcaactttctattttgaggggaaattcaaaaaaggctttgaagatggctatgttaattttagcttttttgaatttaaaacaagttatttttctttacttgagcaggggttccaaataaattattcaaaaggaaatttaaaaatttttaatttacgaagagagaattttgattttaatttaagttatgacaaggctaatggttttgttcgattagatgctttatttttcaatgttagtcttttagattggattaagctaaacaaaggctttgaaatttataaagattattttgatataagtttaaatgggcaattggcattttcttatgattttaaggacaaagatttaagatatgcaggaataatagattcatctttaaatgtagatactataggaaaagaagttcaaggcttgcagcttgaaatcaagggggatgatagaattgtaagtgttaagaatgcttttttaaagcttaaaaggggggttgtaaactataaaggttattattctttgaaagatttgcttccaatgggacgtcttaactttaagtctgcaaaaattttaaactttaacgacctaaatgggtatttagattttaataaagataaagatattttttcggttaagtctgataattttagtcttggaaatcttagttttcaaaatttaattttaaaaacttattttttaaaggataaaatttttgttgactatttgatttatttagaaaataaaaactctcaaatttctttaaaaggagatcttaatgatgaagaattttctttaagcttaggtattaaagaatttcctttgctttttttaaaagaagttattcccagttctcacttgataaatttttttcccaagactttattttcaggtaaatatttaaatttggtttctgattttaattttaataaatttaattatcataaaaataaattaaaaaaattcaatttcatggtattttcaaagttagacaatttcaaatttgtgcttgatgccagtggagaaaaaaatttttacaaatcaaacaattttgatttgcagtacaatgatcacaatttgcattctaacttgtttgttgaactatttgaaagtgggtttaatattagcacgaatttttcttatttgaataaagtttatcctttgcattttaatgttaatcttaaagataagtttattgttgccgaatctcctcttggtattaaattagattttaattattttgattctaaagtagtttatacccttaatgttaatgattttaaggtttacaataaaacctctgatcttttaataaatataaattttaatgggaactatttaggccttaatgaagatttgaaatttaaaatagacgagtttaatataataaaagtttctaaaacacctgcctataatttcaactttggttttaagggcttatatgaatatgataaattgtacatttctgatgttaaacttataaacaaactttcaaatttgcaaggatatggacaatttaatttaaaagataattttaatggaagtttgaatctattttctagcttaaattcagagagatattttttaggggttaattccgatgaatatggaagttattttttgcttaaatttcaagacttagatttttacaattttaattctttctcccttttagagggaaaggttaatggtaattttttgctaaattttaaaaagaatgattttaaaaattattctttgagtggatatcttgaggcakataaattaacttttttgggcgttcccgttcagttttctatgaatttaggattattggataataagcttaacatatatgacataaaagccaagcgcaataaaaaagagtttcttaccggaagcttaagatatgacctaagcagttctataggggtatctaatatagtttttaatagcgacttgttttcttacaggtttaatgcaaattttagaaatttccaaagtggagttgaagagcaatttggagttttgaaaaccaaaacagagggcgaatttttctttagagacattaagtataaaaatgaatctttatccaatcttacgattgaatttagcaatgattttgaaaaatttaatatggcttcaattgattatgaccttgttaatgttttatatcattatggcagtggggaatatagctttattttaaaagattatttgccccttagttttaattcgtcaggcaaaataattaaaaataaaattcttggaaatgtgagagatattaaatttgattcaaaaataatcaccaaagattttttggattcacattctttatttaatgttgacaatcattttattctttacgatcttgttttaaatggtgaattcgatattgatggggatttgtataatcctaatattaatggaagtttaaatattcaaaaaggatcaattagcactgagtatttaagagcttctagaaaatttggtggtgatagagctttagaaatatttgatatgccagttgcaattcaggataataaaatcatttttagtaatgagtttaacctagatcgatattccaagatttttgtttctactagtttaaatttaaattttttaagtgatactattattgattattacaaaatagatattaatgtgactggtagaacgggagttcctattaaatttgaaaaaattgccttaagctttacaggctatgctttaggcgatttttcaattgaaggaaatgctgatgaaattatgtttaaaggcattttaaatatttcaaatgcttgggtttattctcttgaaagttctgttgttgatttattaataaatcctttcaaacgagcaaaaagattgcaaactgatattaatcttctagattttgatattttaactgatcttgagataaattttgacagcggtgttacttttcattggccagatagtaatatttcttttttacaagctactatttcaagaggggataaacttgtaataaaatctgacacaaaaacagatgattttattattaagggagatttgaatattgcaagtggttttgttaattataataataaaaaatttatttttaaaagcggctcttatatatcctttaatgagagtagggctaaatttgatccatggataaaagcggaggctacaaatactattaaggatagaaatgataaactgcttgttacaataagcattgatagtcctttaagtttatggaaaattgagtttatgtcttatccttctagaaatgagcaggaaattaaatatttgctttcaggctcaacaataggagggtatgagggaggattgcgatcggcagggactaatgctgctgaaatggcaattggaatagtaagtgacattgctcttgattttttaattcaacccattgaagattatatgcgttctgtattaaacttagacttgttgagtataaagacagatatattgaaaaattctattaatagtaattttttcaaaatcgggaatcctacttttgttgatgttcttgacaatacaagtgttaaggtaggcaaatatcttgttgagggtgtttttattagtgggggctttggttttttgaaagaacaaatgtctcctttttcaaaagatttaaattttgttgtcaatttgggtattgagtttgattctccattttttttggttaattatgagtttgattacaattttatgaaaaaaggtttagatggaataggaaataatataggcatttcttggaaatttaaatat

SEQ ID NO: 345 - DNA, 555 bp, Borrelia burgdorferi sensu stricto
ttgattaatgctatggagaaatttgtgttttttttgattttaccattgttttttttattatcttttaatgttttttcgatagatgttattaagataggaattgttgattttgatagaattgtgattgaagttttaaatcctcaattgaaagctaatcttgatcaaataaaaaatcggtatcaagaacaaataaatacgttaaatttagagcttaagaatttaaaacatatgtatgataaatcgattgctgataatgatttagataatgcaagatcttttggaaatcaatataatttgaaagttgatgagctaaagagagtgtctagtttagcaaagaataatttagaacagcagagattggccaatattaatagtttaaataataatagtgaatctttaagtaaaatacttcgtggtattcaatatgttgcagaaattaatgggttttctttgattatgaaaaaaaataatccatatattctttaccacaatagcactgttgatataacaaacgatgttgttaagcatcttttagaaaaggacaataaaaaccct

SEQ ID NO: 346 - DNA, 822 bp, Borrelia burgdorferi sensu stricto
atgttaaaaacattaacaaaaataattaccatttcatgcctcatagtgggatgcgcaagcctgccttacactcctccaaaacaaaatctaaattacttaatggaacttttacctggcgcaaatttatacgcccatgtaaatttaattaaaaacaggtctatttataactctttaagccctaaatataaatcagttcttgggcttataagcaatttatactttagctataaaaaagaaaataacgattttgctctactaataatgggtaatttcccaaaagatattttctggggaattcataaaaatagaaatacagaatcaataggcaatatatttacaaatccaaaatggaaacttaaaaattcaaatatatacattattccaaacaaagctagaactagcattgcaataacccaaaaagatataaccgcaaaagacaataatatgctaacaacaaaatatattggggaaatagaaaaaaatgaaatgtttttttggattcaagatccaacattattgctcccaaaccaaatagtaagcagcaaaaatttaattccctttagcagtggaactttgtctataaacagcttaaatcaagaagaatatatttttaaatccttaatcaaaacaaataatccaccaatactaaaaatattgtcaaaaaagttaattccaaccgtcttgacaaacatgacaaacctcacaatatcaagccacataaagaccacaataaaagaccaaaatacggttgaaatagaatttaatattcaaaaatctagtgttgaaagccttatagaaaaactagcttcaaatattcaaacc

SEQ ID NO: 347 - DNA, 969 bp, Borrelia burgdorferi sensu stricto
atgaaaaaaaaaaatttatcaatttacatgataatgctaataagtttattatcatgtaatacaagtgaccccaatgaattaactcgtaaaaaaatgcaagacaagaacgtgaaaattttaggatttttagagaaaattcaagcagataataaagaaattgttgaaaaacatatagaaaaaaaagaaaaacaaatggtgcaggctgcttctgtagcacctattaatgtagagagtaatttcccatattatcttcaagaagaaatagagataaaagaagaagagttggttccaaatactgatgaagaaaagaaggcagagaaggcaattagcgatgggagtcttgaatttgctaaattagttgatgatgaaaataaacttaaaaatgaatctgcgcaattagaatctagttttaataatgtttataaagaaatcttagaacttgcagatttaatacaagcagaggtgcatgttgcaggaaggataaatagctatataaaaaaaagaaagaccactaaagaaaaagaatataagaagagagaaattaagaataagatagaaaaacaggctctaattaagttgttcaatcagttattagaaaaaagaggcgatattgaaaatcttcatactcaattaaatagtggacttagcgagagagcatctgcaaaatacttttttgagaaagccaaagaaactttaaaagctgctattactgaaagattaaataacaaacgtaaaaatcggccatggtgggcaagaagaacacatagtaatttagcaatacaggcaaaaaatgaggcagaggatgctttaaaccaattaagtacttcttcttttaggatacttgaagcaatgaaaataaaggaagatgtaaaacagcttcttgaagaagtaaaatcttttctagattcttcaaagagcaaaatcttttctagtggcgatagattatatgattttttagagacgagtaaa

SEQ ID NO: 348 - DNA, 507 bp, Borrelia burgdorferi sensu stricto
ttgaaaaaaacgattattgtatttataatattagcatttatgcttaattgcaaaaacaaaagtaatgatgccgagccaaacaacgatctagatgaaaaatcgcaagccaaatcaaacctagttgatgaagatagaattgaattcagcaaagcaacacctttagaaaaattagtaagcagattaaacttaaacaacacggaaaaagaaacactaacatttttaacaaacttattaaaagaaaaactagtagatccaaatattggcttacattttaaaaatagcggtggagacgaaagcaaaatagaagaatctgtacaaaaatttctatcagagctaaaagaagatgaaataaaagatctgcttgcgaaaattaaagaaaataaagataaaaaagaaaaagatccagaagagctaaatacttacaaaagcatacttgctagcggatttgatggaatttttaatcaagcagattccaaaaccacacttaataaacttaaagacactata

SEQ ID NO: 349 - DNA, 846 bp, Borrelia burgdorferi sensu stricto
ttgaaaagagtcattgtatcctttgtggttttaatcctagggtgtaatttagatgataattcaaaaatggagagaaagggtagtaataagcttattagagaaagtggatcagataggcggggtcaagaaaatagagccttgggggcgatgaattttgggcttttttctggagattctggtgtagtttatgatttgcaaaattatgaaactttaaaagctcttgaaaataaaaataaatttattgattactctaaaatagagtttttagaaggaacaaaatcaataaatgcttttatttgggcagtttctgttcgttggataaaaattaaagccagagatttgtttggggagtgtggagattttattaaagagcttaagggcattaagtattcttatcttgtttctcctgttgatggaagctatatttcttatgccatgcctataatagtttttgaaactactagagagagtgatccgctttattctgtttctgggtttaaattaataagcaagggaaatgatataaattttaatgaaaataaaagcggattttggggaagacttccaatgtctgaaaaatcagttgaatctgggcttgtaaccgcatatccttttggttctagcgatgctaaaaaagtgattgaagcttttgcttctctttataataatggaacttggagtgatatgattgccgagattactattaagtcaaagcaatatccaaaaaatgaaaaagtttacagaattacgcttgattctcagctttttaatgttgctatgaaaaaaataattgaaaaatatcctaaaataaaaagtgcaagttttgcatttaattcgttaattaac

SEQ ID NO: 350 - DNA, 543 bp, Borrelia burgdorferi sensu stricto
gtggagataaagataaataaaagaaatttatctgaaagcgttagagaagaagagcaagcacttgttcattataataaacttaaagaaaaattaaacattaattttcaaaaagaaatttattgcaaaatagaagcaatgaaggttttaaaagaaattaaagataaagaatattataaacttgacaattattccagttttgatgattttgcaaaagactatagacttgccagaactcaaacttataagtatcttaaaattgcaacagcaatagaagaagggcttattgaagaaaagtatgtagttaaaaacggaatcaatgatacaatttgtcttcttaaaacaaaagaaagtccaagtttaaaaaaatctaatcaaaacccaataaaaccactaagatttcagcttaaaaaggaagaagcttattctttttataaaaaaaatcccaagcttacaagctttcttttagagaaaattttttttaaggaaaaagattttttattaaaaataattaaagaatttgaaactttaagaaataaacgaaaa

SEQ ID NO: 351 - DNA, 573 bp, Borrelia burgdorferi sensu stricto
atgattaaatgtaataataaaacttttaacaatttacttaaactaactatacttgttaacctacttatatcatgtggactaacaggagcaacaaaaattagattagaacgaagcgctaaagacattacagatgaaatagatgcaattaaaaaagacgctgctcttaagggcgtaaattttgatgcctttaaagataaaaaaacgggtagtggggtatcagaaaatccattcatacttgaagcaaaagtgcgagctactacagtagcggaaaaattcgtaatagcaatagaagaggaagctactaaactcaaagaaactggaagtagtggtgaattttcagcaatgtatgatttaatgtttgaagtctcaaaaccattacaaaaattgggaatacaagagatgacaaaaacagtctcagatgcagctgaagagaatcctccaactacagctcaaggagtgcttgaaattgcaaaaaaaatgagagaaaaattacaaagggttcatacaaaaaactactgcacccttaaaaagaaggaaaattctacttttactgatgaaaaatgcaaaaataac

SEQ ID NO: 352 - DNA, 1587 bp, Borrelia burgdorferi sensu stricto
atgataataaaaaaaagaggacttttaatactgggcattgctactgtaatctcgtgctcagcaatgtctaaaccaaaagatgatattgtctttggtgttggaattggaaacgaaccaacatcgcttgatccacaattttgcagcgataggctaggtaatttaattataaacgaactatttgtagggcttttaaggggtgaccccaaaacgggtggatacaggccaggacttgcaaaaaattgggacatttcttacgacaacacctgctatacattccatttaagagacgacatttattggagtgacggcattaaaataacagcaagcaccattagagattcctacataatggccttagaaaatgagcttgatgtgccacatattaacctattaacatcaaagataaaaaatgcacaagaattttacgaaacaaaattaaatgcagatgaagttggagtaaaggtaatcaatgagcaaactttagaaataactctctctcgcccagcaagatattttcttgacatgcttacacacccaatatttatacccattcctacgcacattgttaaaaagtttggaaacaaatggacaagctcagaaaacatggttacaagcgggcctttcaagctaaaaagaaggatcttaaacgaagaaatatctcttgaaaaaaatgaaaaattctatgatgctaaaaacgttgctattaatgagctcatatttgttactataaacgacacccgcagaatttacagtatgtacgagcacaacgaaatagatgctatttttaataacatccccttaagccttattaatgagcttatcttaagagaagatttttattcagctgacattaatcaaattgggtttttttcactaaacacaaatgttaaacctcttaacaatgtaaaagtaagagaagcattggctcttgcggttgacagagaaactctaacttacagagttcttgacaacaactttaaagcaacaagaaaaataagccctaatattaacaactataattatgggaaaaagcttaagccatacaacccgcgaaaagcagaaaagctcttagccgaagctggatatccagatggtaaaaattttccaactcttacaataaaatacaataaaaatgaccttgaaaaagaagttgctagttttattcaaagccaatggaaaaaagttttaaatattgatgtagaaattgagcctgaaacatgggtcaaccacatatcaaatattttaaaaggtcaatatgagatctcagtaaggtcctggcaaggagattatttagatcccatggcattctttaatatatttgaaactaaaaactcacattttgcatcttacggatattcaaatcctgaacttgatgagcttataataaaatccgatcttgaagaggatgaaaaactaagattagaaatattaaaaaagatagaagaaataattattgaaaatgattatccaataattccaatatacagtgttgcgggaaactatctttttaaaaacgacaaatggctagggtggaatacaaacaattcagaaagatttgccctatcagaaataaaacctatagaagaa

SEQ ID NO: 353 - DNA, 651 bp, Borrelia burgdorferi sensu stricto
atgaaaggaataagtattttatcattactattattggcattttcttgcaaacaatatggtagtgttaaggcactcacagaaattgcttctgattctggagataataattcacttgtcgttagtgataatttagcggctaaagagctgattgccgaaaaagggcctactttaacatcacaggaatctgaaagattagaggctttaaaaacctttttaaaagacgcaatgggtgttaatggtaaaacaggcgatacaaaagccgagtacgacaaatcttataaagaattttttgattggctttctaaggatgttaacaaacaaaaagagtttgtaagttgttttaacaatatttgtggcattgttactaaagcagtagatgcaagcaagcaaaggtataagggcaatcaacaatccttaggttttaatgaatatgtttgttatgatattaaaaccagaactggagatgatttaagtttatttttccaaaaagtagctgatgcatttggtgctgaagagtacaaaaagaaagatgatgagagcagtcaaaagcctgagaaatgcaatgaagagattttcaaagtaatcaaaagagtgtttacagaaagtgatagtaataatgaattaaaaaatttaaaaaatcatggaaatatc

SEQ ID NO: 354 - DNA, 1242 bp, Borrelia burgdorferi sensu stricto
ttgaacggcaagcttagaaaagctttaaaaattgcaatatttacaacattgctgctagttattagctgtaatgcaaatatggatacaaacgataaaaacaaagccttaaacgaatataaattaaaaaatatttcagaagtcattaagaacagcttgcagcttgaatcagaccctaaattaaaaaaagaacctgaatcaaacataaatcaaagcacaccccctattttagaaattgaaaaaatcgaacctggaaaacaagagatgtccttaaaatctgaatttggcagcgaaagcttaatgccactagaagaaccagaagaagcaaatatggcaaaatcagaagaagaaattgcaaaaatacaagaaaaattattgttaattggagcttctgacgagatcacagatcaagaattgggcgaaaatatgcaaaaatttttaaatccaactacagtagaatttaaaatttcaacaaccaccaacgaaacaatacttaccacaattgaagaagaagaaattaataacaacaaagacaaaatttttgaccacaaagaagaaaatgtcactttaggaaataactctttagaaaatgcaactttaaacaaaaacacaataaccttagcacaaaaccaaaaatacaccactcacttaaaaaatgatgacaaattcataacaaaagaatacttaaagcaagttagagactctctagataaagcgctaaatgcaataaaaaatttagaaacatctaaagaatttagagagcttgaaaatttaccaaaggatcaagaaaactctccaagcgcaaaaaaagaatcaactgagagcaacattaataatactaataccgagaacatagaaataataaaaaacagattgctcgaagagctaaacaaaagtgagcttatttttgaagacactaaagatcccctaggaacaagcacaataaaaaaggtcatagatgctgctaaaaaatggcaggaaaaagaaaattcaagtcaaatagactgggacttgggctttaagtttcacccaaacccaaaattttacaacaaattgacagctcaagaatataaagttttggctgaaaaatttactaaagttaaaaatgaatacaaaaacacaaaagaacaactaaaagctgagtccaaattaacaaccaacagcatcagcaaaataattaacgcaacaaaagaatttgcaaaccaggtaataaacttaatcttattggtagaaaaaaattatcaa

SEQ ID NO: 355 - DNA, 888 bp, Borrelia burgdorferi sensu stricto
ttgaaaagaaacaaaatttggaaaacgttaaaactgtttcaaataactttactgttctcatgctctttttattctaaatcaaacaacacagaagcgataagtgaattacaatcaagccctattaaacttggaaaaattaaagttttacaaaaaacagaaaagattgtaagcacccaaaatcttcaaaacttacaacaaagccagttctttaaaaatgaaaaagaaaaaataattaaaaaaattgcacaagaatttgatgagaatgaaaaattgattaataaaataggtccaaatatcgaaatgtttgctcaaacaataaacacggatattcaaaaaatcgaacctaatgatcaatttggaataaataaaactttattcacagaaaaaaaagacaataatattgactttatgttaaaagacaatcgacttagaagattattttactcatctttaaattatgatgaaaataaaatcaaaaaattagccacaatactcgcgcaaacatcaagctcaaacgactaccattacacacttattggtttaattttttggacaggatttaaaatccaagaagcatttgaaagcgctgttaatattttaactaaagacgagcaaaagcgcctaatttttaattttagaacaaaaacagtaaaagagattcaggaaaattttgaaaaactaatgcaagagagaaattcatggataaaaatcgtcgataacattattggcgaatatgacaaaaatacgggaggatgcaaagctgatggaaaaattctcggagaagtaataagggttggatacgagcatgaactcgactcaaataaaagtatgcaaattttaaacaatattgaaacaccgctaaaaacctgttgtgaccacatacactac

SEQ ID NO: 356 - DNA, 1095 bp, Borrelia burgdorferi sensu stricto
atgaaagaaattggaatatccatataccccaatgtaagtcctaaaaataaaattattaaatatcttgaaaaaagtgctcattttggatttactcaagtatttacctctttgctctatattaacggaaatgaatttgacatattcaaagaattacttagcattgcaaataaaaacggaatgaaacctattattgacgtaagtcctgaaattttcaaagaattaggcattgatctttcaaatcttagaaattgtccaaaactagattattttaaaaagcttggcgcctgggcaattagattagacaatacattcacaggcattgaagaatcattaatgacttttaacgactctgaccttaagattcaacttaatataagcaatataaataaacatattgatacaataatgtattttaagcctaatataaaaaatttacttgggtgtcataatttttatcctcacaaatatacaggactttcaagaaatttctttaaagaaacaacaaaaatatttaaacattattcaatcccaacagccgcatttattagctctaataatgcagaagaatgcgcacgagggaaagaaaaagaaggtgttcctacgctagaatcacatagatctaaagatatagaaacccaagcaaaagatcttttcaaagaaggaatagatacagtcctaatttctaattgttttccaagtgaaacagaactaaaaaaagtatcaaaggtaaacagaaatattttagagctcaaagcagacctaaatccagatgcaaattcagtagaaaaagaaataatccttgaaaatttacattttaatagaggtgacattaattcctatagaattcgatcaactatgccaagagtgtactacaataataaaaaatttcctgtacattctccaaatgaaattaaaaaaggagacatcctaatagattcttcagaatacttgggttatacaggagaacttcaaatagcactaaaagataccccaaataatggtcttgtaaacgtagttgggaaaataatcaatgatgaaatatatctacttgaaaaaatagaaccttgggaaaaattcaaaataatagaaaataaa

SEQ ID NO: 357 - DNA, 1590 bp, Borrelia burgdorferi sensu stricto
atgaaaatattgataaaaaagttaaaagttgtattatttctcaatttaattttacttatttcttgtgttaatgaaagtaatagaaacaaattggtttttaagctaaatattggaagtgagcctgctactttagatgctcaattaataaacgatacggttggatcagggattgtaagccaaatgtttcttggcattttagatggagatcccaggactggaggatacagaccgggacttgctaaaagttgggatatttctgatgacggagtagtttatacgtttcatttaagagataatcttgtttggagtgatggagtttccattactgccgaaggaataagaaaatcttatcttagaattttagataaagaaaccggctcatcttttgttaacatgattaagtccgttattaaaaatgcagaagagtattttgacggcaaagcaaatgagtctgagcttggaattaaagctcttgatgaaaaaactttagaaataacgctaaaatctccaaagccatattttcttgatatgttagtacatcaaacatttattcctgtaccaatgcacgttattgaaaagtatgggcaaaggtggacagaccccgagaatatggttgttagtggtcctttcaaattaaaatctagagttttaaatgaaaaggttgttcttgaaaagaataataaatattataattccaaagatgttgttcttgacagtattatattttttgtcacagataatagcattacagcttataatatgtatttaaatgatgagctggatgcaatttttaagaatgttccaccagatttgcttaaggatcttaagcttagggacgattattattcaatgggtattaattcaacctctttttattctttgaacatgaaagtaaaaccgcttgacaatgttaaagttagaaaggcgctgtcttttgctattgatagaaaaaccttaacagagagcgttcttaatgatagttctattcctacaagaagagcaactccagattatattgattactcttataaaagcaatttgagcttatttgatgctgaaatggcaaagaagcttttggcagatgcaggatatcccaatggtaataattttcctttattaaaagtaaagtacaatacaagtgatagccagagaaaaattgctgaatttattcaaaatcagtggaagaaaaacttaaatattaatgtacagcttgagaatgaagaatggtcaacatatataaatagtagagtaaatggtaattatgaaataataagatcaggatggtcaggagattatgctgatcctatgacgttcttaagcatctttcaaactgaaaatacatctttttcatcttatggatattcaaattctgaatatgatgaacttttaataaaatcagataatgagagagatatttttaaaagacaggaaattctaaaaaaagcagaagcaataataattgaaagagattttccggctgtatttcttaatataacttcttctagttatctttttagaaacgacaagtggaaaggttgggagccaaatatttcggaaagatttaatttatctgaaataaaaccaattaaa

SEQ ID NO: 358 - DNA, 1212 bp, Borrelia burgdorferi sensu stricto
atgccaaataagataacaaaagaagctttaacttttgatgatgtgtctttaattccaagaaaatcatctgtattacctagtgaggttagtttaaaaacacaattaacaaaaaacatatccctaaacataccatttttaagctcagcaatggatactgttacagaaagccaaatggcaatagccattgctaaagagggtggaataggaattatacataaaaatatgtcaatagaagctcaaagaaaagagatagaaaaagtaaaaacatataaattccaaaagactattaacactaatggagatacaaatgagcaaaaacccgaaatatttacagcaaaacaacatctagaaaaatccgatgcatacaaaaatgcagaacacaaagaagattttcctaatgcatgcaaagatttaaataacaagctaagagtaggtgctgctgtttctattgatattgataccatagaacgagttgaagagcttgtaaaagcacatgtagatatacttgtcatagactctgcccatggacattctacaagaataatagagcttatcaaaaaaattaaaaccaagtacccaaacttagaccttattgctggcaacatagtaactaaagaagctgcattagatttaataagtgtaggagcagattgtttaaaagtaggaataggtccgggtagtatatgcacaacaagaatcgttgcgggagttggagttccccaaataacagcaatctgcgatgtctatgaggcttgtaataatacaaatatttgtattatagcagatggcggaattaggttttcaggagatgtggttaaagccatcgcagcaggagctgatagcgtaatgataggcaatctctttgcaggcacaaaagaatctccttctgaagaaataatttacaatggaaaaaaattcaaatcttacgttggaatgggctctatttctgctatgaaaagaggctccaaatcaagatattttcaactagaaaacaacgaacctaaaaaattagtccccgaaggaattgaaggcatggtaccgtattctggaaaattaaaagatattttgactcaattaaaaggcggtttaatgtctggaatgggctatttaggagcagcaacaatatctgatttaaaaataaattctaagtttgtaaaaataagccattcttcattaaaagaatcccatcctcacgatgtttttagcataaca

SEQ ID NO: 359 - DNA, 636 bp, Borrelia burgdorferi sensu stricto; identical to SEQ ID NO: 91

SEQ ID NO: 360 - DNA, 1107 bp, Borrelia burgdorferi sensu stricto
atggaaaattctaaaaaaaataccctttgccaaaataagacacaacataaatcaatagttcttatctcaacactagagtatataaacaaaacacataataaatacacacaaaaaaacatactctattactttaatgaaaatcttaaaagaaatggtcaactacccgttaaaataaaaacactgcaaaattatctttacaaattagaaaaagaaattaaagtaacaactaattatcacaaacacttaggagtaaattgcggcaccgaaatatactatcaacttaatttttcaaaaaaagaatgttaccaaaaaatctataaatactttcaagaaaaaaaagatttaagatttcaaaatagagctacaaggggccttaaagatagatttactaaaaatgggagtgtagatttaaaggagtgtttaaataataaaaataatataaaagaagaaagaaagattaatgaaatagaaaagtatcaagtaagaaattacttcaataaatgtaactttttatgtaaaaaaattctttcaatttttcttacaattttattcaatttagatattgataaagataatataatcaaaatacttaaaatcataaaaataatagaaattaaattgctaaaaaataaaaatatacattttactaaatcttgcatgaaagaaaaacaagaaaaattaaagaaaattctatgcaacactcaaaaagaatttgaaaaaaatgaatataatcctaaacaattagaaataagtttccaaaaaatatacgaaaattacaaatttaagcctcattttattattgaaagtcataaatatagcgatttaaacaatataaagcgtaaattagagaagtcaattgaaagaaaaaaagaaaattctcaacaaaattatcaagatttaaaaacaaacattttcaatatccttattgaacaactaaaaaaagaagtaaatattgaacttctaaagccaattataaaagaatatttgaataaccaaaagaaaatagaatacaataaagtgttttgcacatattattgcgaattattagaactaataaaaaaccaaaaaagtttattgaatttaaaagaattagatagaaaggctata

SEQ ID NO: 361 - DNA, 3294 bp, Borrelia burgdorferi sensu stricto
atgaaacttgatgaaataataattccgctatcaatgtcgatcagcaataatcaaaagctggacgcaatagcagaaactctaaaaaaaattgccgaacaaaaattttcaagtctggatgatttgaagtcaaaattagaaaaatctgctaaatctggatccaacttagagaaagcgctaaacaaaagttcgcagaatgctattaaaaacttcaaatctcttgcaaattctgttaattccgtaaattccaaagctggcagcatgaaaagtataggcaaagttctaaaaagtgttggaaaaggcttaggaagtgtaaagaatttggcaaacaaaactggtgaggcattcaaccaaatgttggcggcttttgccccaattattatggctgtaaaggctatacaagcaatcggctctacaataagtggaatttttgatggcgctatggatgctcttgatgaattcaacgaagaagtgtcaacgttttctgacatgcttggaaacgaagaccttggaaaatctttagcagaatccatgagggcttttggcgatgaaactctttttactagagacgctattgctaatgctactaaaacaatgctttcttatggtgcaactgcgagtgaagttgaagagagaattagaatgtttggggaggctgctggtggaagtagcgaggggcttgagaaattagccgaagtatattctcgtgtagaatcgagcaatcaagtgaatttagaagatttgtatgcacttcgtgacgcgggtgttgacattacagacattttggcagaagaagctggtttagctggagaggcattatataaggcagcgagcgatggaaaaataggattcgacgccctaaataaagctctttccaaagccactagcgaaggtggtaaattttatgggaacaccgccaaagaagcaaaaactttagctcaagctcaacaacaaactgccaaaatgagcgaaaagcttttcttagacattggaaaagctctagagccaatgatgattggatttgaaaaagtaaaacaatttcttatggtagcaatcatggttcctttgaccaaggtgactacagctacaatatacttaactaccaaattgggtgagcttgtagcatatcttgccggcaagtgggtgcaaggcatgaaaatgttgttcaaggccattaccacgccctttgttaagctctacgagggaatcaaatacgtaatcggcaagctaaaagaacttgcaacatatgtttctagtggatttttagatcgttttaagggtgcgtttgagcccattatcaaatgggttcaaaagttgatagatatgatatccaaagcgtatacaaaattgaaaaatctggttactttttggaaaaaagccgaaaaggaaaaagacacttctggttccgaacccgaaagggataaaaagtttgatccaaatgcaaaaaccaatattaacaagaaaatggcagaagactatcaaaagctgcaagacgaaatatttaataggcagagggacatctataataagaccgggaaagcacgagaacaagccttaaggaatcttgaaaaaaccataaatgaaaaaaaccaaaagtttaaggatgaatactccaaaatatttgatcagttaactgacgagaacaagaaaattttagtcggagttgaaaaatcagtaaatgagttcaataactccaattatgattttgtgaatgagtaccaaaatttactaaaagaaaaagaaagtcgtgaaagggaaataatcaaaactctgccccatacagatcaagtaagcgctttacagaaacttaatgatgaaatcaatgaaaagaacaaagcgttcgtagaaaaatatggaaaaagtttcgaaactctgaacgagtctaacaggcaagttgtagtcgcacttgaaaagcaggttaatgaatatgaaaaaaccgctttagatcgatcttttgtcgaggctcaaaaagctctgcaaaaagaaataaccgacttagagtgggaaacaatgctacttccagcaaaagaaagagcaagtgctgaaaaaaagatggcatccaaaattcaagcaatgtataaaaaattcgtggatgagcacaaatcgcaatttaaaaagctaaatgaaaccaatagaaacactataaaacaatatgctgagaaagctcaagatacgacaaaaagcttatatgacagcatgatagacggcctaaatgtctttaagaatgcctttatgaaagatatagcgggcaaatttttgaataaggatacgggagaaagtattggagaagaatttcataatttgattaatgggaaggatgtgaattggggtgaaggtctggaaaaaatgacaacacaaatgtacgaatcttggaaaactggattaaaaactgctgctggagcagtttttggaccttggggagaagctgttgcggagcttataaacggattgaccgattttgtttggggaattttgaaggggcaagaaaaagcgagaattaaagcaattgaaaaaaaacgggacgaagatttggaagaacttgaaaaacgaagtgaagtcgaacttaaaaagcttgaagatcgttttgatgaagaaatcaaaatgagaaaagaaaaattgagcgaattagatgatgaatacactaaagaaatagaatttctcaaacaagctcaaagtaaaggacaaatatctggtgaagaatttcaaaaaagattacacgatgtacaaacagaatataaaacaaaaaaagatatagaaaccacccaacttactaagaccgaagaggctaaaaaactagaagtagaacgcaaaaacaaactttctaaactagagcccgaacgaataaaagcacaggccgaagttgataaggtaaatgctgaagattggtggaatttgggcaagcctgataggttaagaaaaacacaaaaaattttagacgaaatactaaaaagaattgcaaaagtaaaatcagctggatctattgaagagataaaacttgctcatggcggtgcacgatttgtttcaaataaaccgacatatatgccaaactcaggtgtaatgtctagtgagtttggtcaaccagaattagtaagaataactccagcaccaatagatgaaaatctacgcaaacttgaagctaaaattattgcagaagaaattactaaattacaaaaaactcaaagcagtacagttgtaaataatttttactataactttaatggagatgtgcttgatgctgagaaattagttagaatgctaaaatcaaaagaacatttaatgggattcagaatggcagag

SEQ ID NO: 362 - DNA, 426 bp, Borrelia burgdorferi sensu stricto
atggtaattaatgttaatttgactggcagggtaatgttaccctatatcccagactatattagaaacggcaaggaaaagatcaaagaagaagagaaagcatatgtggttttgaaagacattaactatgggtttgtggaaaatctaaaggcaagacaaatcgaacttttcaaaaaattgaatggcgagaatggtaaaaccaattccaatgctatgattgagtcaacaagcgctcaaattcaatttgtaaaaaaaatttgggatgaaaatgtggtaggattcgtcggtcttgaaaatcaacaaggagaggttatcaccaaagagatggttgaaggtgacgctatcttgtttcaagacatgctttcaagtcttgcaatcgaaattaattttctggcagatactctaagggttgagcgtgtttcaaaaaag

SEQ ID NO: 363 - DNA, 1188 bp, Borrelia burgdorferi sensu stricto
atgagactaaggcgacttccagtatatgttgatgcctacaaagaaaagcccaatgctgaaattttcatatactactcaagtaggggaactggtaaaacctacgacattgcaactgttaatttagaaagaaaatttagtgctgatggcggagatacccttgcaattagaaaaaagaaaaacaaaacaacacaatcaatacacaaagaaattttagaacttttaagcatatacaacttaagaaaatttttcaatataagcaaagcaaaaattgaaagtaagagtttgatttttgggaaaaaacgtgcttttgtttttgaaggggggcatgatacaagagatttaaaatcttatgcgcattttaaggacttatggctggaagaagccaatcagtttagcgctgatgatatagaaatgcttgtccctacaatgagagaacaaggcggcagaatctatatgtcaagcaatccggtgcctaaatcacattggctatacaaaaggtacttatcaaatcaagacaatcctgctgtgtgtataatcaaaagcacttaccgtgacaacccatttttaaatggtggagacgtacaagcttggcttgaaaaacaaagacttgcatatcatggcaatgacattggttttagaattgaggttttaggagaagagtttgattttggtacagcaaggctaattaaaaaatttaatgtgtgtggtcccgaaattctttccagagctaatggaagctattatacaggaatacacgttaaaggcaacagaatttgttttttagaaattcttgttggaagaatttcctatcttccagttgtaattattacaaacgcatgtagtaaagttttactatcaaaaactgattaccaatccgaaattaataaatttaaaggggtttttgtattgccaacagcaagagaagaactcaaatatgtattttctcgttttggtagaggtactttgcttgcaaaaaaacgaaacttgtattcactctcagactatttgattccgtctaatcttaatgtggtaaacaaacccgaaaccactgatgtaatttcagagttcaacgaaactgaatattattatgatgaatctagtgcagaagatagcgaagttacaaattttgttatgcaaaaagatttggtatacatcccggcatttctcaatgccatatcggtttttagc

SEQ ID NO: 364 - DNA, 780 bp, Borrelia burgdorferi sensu stricto
atgttaagtgatgatgattttgaaaacatcaaaaaaagacttcaagccgacaatatcaaaattcaatttggcgttggaactatggaagaagcaaaaaattatgttggcaaacttggcgaacctattgttgttaaagataaagaattatttgctatttgcaatggtaaagatactactaatagaaaatattatcccattaacaagaataccaagccccctattggcgaaaatatagatgattatttaaaagacttagttaattggtgtttagaaaacacttatcctggatttttaactgcagaattcgtcgagcaaggatctatatcaagaagcaagttggtacaagcttttgaagatactaaaaaattttgtattccagatggaagacctctcccagacaattgttttgtaaaagaaaagtttggaatatctttggcacctaagttgtcgggcagattcttgagacactatgattctggcggctccaccgattctgacggtacaagaagcttagggcatacacaagaagattcttataagagtcacgatcatgatcttgacttgagcgtattggatagtctgcgagggcgacttgtgactgattactcctccatcagaagagattctaattggagtacaggctccacctcttttgttactcatatagaatacggtgaaccaatacagtcgtggcgatacccttcctacacaaaatacagtggagatgacgaaacacgacccaaaaatacatgttatatttcattctacagatatgattgg

SEQ ID NO: 365 - DNA, 2688 bp, Borrelia burgdorferi sensu stricto
ttgtatttgggtgttacaaaaaatacagcagaagataaggattgtattaagttgaaagatcaagacaattcaagtcaagaatccgaagccttaaatcaagaaaccgaaaaaggtgccgaaactgaagaaatctcaaatcccaaagaagatacatcggaaaattgtacttctttggggcttgatattgtattctacacggacgagggtcaaatttttgaacttaccccttttgttgacactacaagcattgttctagaagaaaaaatagttgatccaagcctaaaaacagcagcaagcacgttcagctttagtgtaagcggcctatcagaagaatttttgaatttcttattcttcagaaacgaagacattttcgtaaaagtaaatgataagaataaccccgtttttaggggaattctagaaaaatttttcagcagagatctgttcaatagcaccaaaagtgtatcattcaccgttaacgactactctagcctactaaagattgcattcgaaaatccagttcaattcccaatcaattttttaccagactggctttttgtatacaatcctttagcaaaagaactttcacttgtccatctaataatagaaaaaactaaactaaaagaccttattgatgatgatgctagcgaagcaatacttgacaaagtccccgctgtaatcattgattctggagaagatgtagaaactattttgcaagccttgttgtatgaattcggatacgcatacactttctcttcagtcggcaaactacaaatacttccaatttggaaaagcgaagttattactaaagaaattgaaatttgtactgtggatgctgaaagttatgttatgtcaaaaagtagctccagtagctacgattcaactaaagttatttggagagaaggcaaattccaaagcaaagaagaagcaatgtccaaaaaacgaccactgtactcagccccaatcaatgttgctggtaccgatggtgcactgtacgttgcagttcttcaaaaaggcgtagtgtaccccgactttgcagacaaggtcggaagcagtgtttttcaagaatacgatcctagctggttagatacagtttacaaatgggacttcaaaaggcgcgaggtttggcacgaccactacgccataaatgaacatttagcaataatctcaactcataaccttgaagtaaggtttagtgccgactcctccatcaagcttgaaaataaagaatattttccaacaaaggctaagctttggtttagaaacacttctagtagtcaaggctccaaatatatttaccactttgacatttatggtgatgttttctacacaatagctcaaaatgtactccaaaccgacaatgctgatgatttttactctaaaaagtttgaatacacaaccagattcattttttccgaagattcagcattaagactttttgaattcctaacaaacttacgtgtcaaaggacacactattgttaattttaggtcaatgcagaatctaaatataaccgattttgtcaaacttagacttgacaatattgggattgatcattttttccttatactttcaaaaaaaattactaatttcgatctggatatcaaactttacgagtacgagggaatcacttggggtgactacactcattacgaataccttacaacttcaaccaaaataggaataagcgactatttgtctggggctcacaaagttgttattgcaccgtttaattatgatggggccgaaacttaccaatttaaagcctccgggtttaaagacgaaaatactttaaatggttcaattgaatttgcaaaacaagctggacttaacaagatcaaactacttaaaggcgatttttacatttatgatcaagtaaaactaaacaatttagaaatcgaaggcgatgacgaagttttcataagaagcacggggttttctaaacatatttttacatcagaaaaatcattcaggctttctggagtcaatatatgtcaacaaccaatgagtgaactttacattaacggaggagatctaaaccaacaagaactggcaccttacctagaagacaaaagctttacacagcccgctgttgtagtgctctgctcatcatattcattgcaagaagaggccagatcatcagtctatgttacagatgcaagctttgtgtacatcaaaaatgtcacatttacgtgcgcattaaacaaagcattgcatttcaaaaaaacaaaaaaaattttacttgaagatgtaaattttgattctacaaatcaaagttttgacatagaaaatgttaccaatctaacactaattaatgttaatgctcaaggaagcaaaactgcatcagttgcaaatggacttaatgcaataattagagaaagcttctttaccaacaacaccaatgcgcttaagctttccaacttttcaagtttgaaaataaccgacacacagtttatcaaaaatagcggtactgcgctgcatttacaagatattactagcgcaagactaagtaacaatacgtttacagaaaataaagttggacttgaaaatcatgcttttgacttgatcgtacgcgatacttttgtaaaaaacacacttgcccttaatttagcaagaaaatcaaatgcaggggtgcgaacacttgatcttagcacttacatggaaaacactaaagacaaacaggaggttgct

SEQ ID NO: 366 - DNA, 426 bp, Borrelia burgdorferi sensu stricto
gtggctttaggaggtaaaatgagaataagaatgaaacatttagtaagaaggctttacttaagaagggacaagatttggcatgtttacagaagtacggaaattcaaaacaaagctaaagacaaaagcattactaattttcctaaattagaaccagaagattttgactatgagtatatttacaagttcgtggatgagtggattcagaagaaatacaacgataaattagggtttaccatccaaaaggtagatggtcttgaatatatttgtaaggcaaaaaggtatgcaagtttaaagaaaatattggctaggattgtcaaagactataaagatatatttcttggcaggttgcaaaagaatgttgctggtgcacaagcgggatccggggggagtggaggtaaggggagcaagccggcgggaacaggagga

SEQ ID NO: 367 - DNA, 666 bp, Borrelia burgdorferi sensu stricto
atgaaagcagttttggcaacgacaaatattaccgaagatcaaatatatagagagtttctgcgactaggaatggaacagttaatagctcaagatttgtcaaaaagatattatcacaatgagcttacatatagagatttggaaaatttagaaaaacaattcggtataaggttcgagaaccttatttctgagatttcttttttagaaaagaatttacaaaaagacatatttaatttagatgctaagatagattctgtagaaaagaatttacaaaaagacatatttaatttagatgctaagatagattctgtagaaaagaatttacaaaaagacatatttaatttagatgctaagatagattctgtagaaaagaatttacaaaaagacatatttaatttagatgctaagatagattctgtagaaaagaatttacaaaaagacatatttaatttagatgctaagatagattctgtagaaaagaatttacaaaaagacatatttaatttggcacaagctcttaaaaaagaagttcaaattaatagtcaatttttattggaaaaactcaaggtgagcaacagaataataattattattacagtaataatagttcccattgctatatctagcataacaaatattgttatgctactaattgctaaattttttaaa

SEQ ID NO: 368 - DNA, 3831 bp, Borrelia burgdorferi sensu stricto
atgaaaactaatgatatcgtaaaaacaaataatcctaatatatctctttataaacaattatcaaaagactttataaaaaaggaaaatattaataagctaaaagacttttttattcttataaaaaataaacttttttcaatagatgataattccacagaagcaaatatagagtctttgctaaagtatatatttgaagaactaaattattcagtagaacaacaaaaagccggtcaaatagaaggagtggagtctagagtagatatactgctttttgaaaacgacaaagacaaagcatcctttaataataaattaaaagaagctaaaaaaaataatgaacctattcctatcgaagatatcttgattatagcagaggttaagcgcccaacatttagttttgatgctaaagataaattaaaagaatcagaagatcagctatatagatatctaaatcaatatcaaaaacattatgggatactttcaaatggaaaggtatggagattatatgacaaatcgaaagtactttatggagaaaaaagatatattgaattcaattttkctaaaattgaagaaaaagaagaatataaggaacaagaatggtttgttttattcatctaccttataagaaaagaaagatatctaaagacaagtaatgtaatagaggttgaaaaagaacaaatagctaaagaaaaagagataattcaaaaaactctaaaagagatactttatgagagacccgacgactctatagtatttaaaattgcaaaaaatatatatgacaaagaatttaaattatcaggcaaagaaattactcagcatattttagctagcattcttgaagaatcaattatttttattttaagaatattttttattgcatatattgaagataacgacatttttaagaaaatattacaagaaaataagctatacagatcttctatatcttttagatattttttttatgatgaaaatacaaaaaagaaattagaatataaaaaaataataacaattttcaatttacttgataaaggaagtgatgcaataaagtttcctgtatttaatggagggttattttcagaagataaggttaaatatttaaataatgaaggtttgctcagtattagcgagattgaagaaatactagttaaaatgcttttctttgaagaaaaaaatattaaagatgaaaaatttgtaaagtattcaaggttagatcctaaaagttttggagaattatacgaaactctacttgaatatgacctaagaattgcagataccactgttcatcgtattattgaagacggagtttaccttattcgtactgaagaagagcttgaaaataagaaagtaaacaaaattgctacatatcttaaaggtaatatttatcttacatctagatcacttgatagaaagaaaagtggggcatattatactccagatgacttgactgattttatggtcatatcatcaattgaagagcagcttaaaaccaaatcccctttagatataaagataattgataattcttgtggatcagggcattttttaatttcttgtctagattacttaacagaaaaggtatggtacgagctagataaatttgaagatgtaaaaaaagaacttgatgaagaatatagggttattattgaagaaagtgaagagtatgatgttcaagatagtataagtaaagaattagtacttaaaaggatgttactaaagragtgtatttatggtgttgatattaatcccatttcagttgaaattactatgctaagtttgtggattaatacttttatttttggaacaccactaagctttattgaacatcatataaaagcaggaaatgccctgctaggatataccaaagatgaattctttgatattgtaaaaaagaaatttgaaagtggattttctttgtttaaaaaaagaattaaagaaattataactattttagaagatatttatcaaaaaattaaaggtattaatgatactactaaagaagatatagaaaaatctaaaaagatatacaaagaatatgaagaaagtaaagatatagataatttaagaataatattttctttaattaaactttattcattatcttttgataaatctttaaatatggaatttagtgatattgcgtctgtaattagtttaattgaaaatattttgggcaataaaacttctagtgaagataaagaaaaaatagaaaaaattagaaaattaagtagctactataaattttttcactatggaattgaatttccagatattcaagaaggatttgatattgtaattggaaatcctccatgggagaaaactaaatttaatgaaacagagtttttttcaaaacatattcctaactacagaaaactaggcataaaagaacaaaatatcataaaacaagaaatacttagtaaagataatcatcctttgagtattgaatacaatgaagaaaaaaatagtataattgccattaataatatttataaatttgattttaaatgctttactagtggtggagacccaaatctttttagatactttgttacatttaatttaaaattaataaaagaaaaaggtaatttaacttatttagttccttcagctatttggaatgaatctagttctagaatactaagaaaacatatatttgctcgctataaacttaactatatttatcaatttgaaaacaaaaaaagatttaaagatgtgcattcaagttttaaatttgcaatatttcaacttagtaatattaaagaatctacatcgagctttaaagcaaaattcatgattcagagtagtgataatattttaaaagaaataactagggatttgaaagatagtaaagacgatgcttataaaggaattgaattaaatataaatcaaattaagaagctatctcctattcaagaatcaataatagaattcaaagacaatgaagaatttactcttattaataaaatgtttagcaaatttagtgctcttggtgaaggatatattgattttaaaaaaggcttagatccaagcattaagaatcgtaaatctttattaaaagaatgtaataataaaaatcttatatttctttattctggagctaatattcatcaatttaattcaagattttttgaagataaagatgcaaaagaaagctctaaattgctatggatagataaagaggatttggaaaaggtattaactaaagataaccaatatcaaaccgaaagagtattttatagagcaattgcaagcaacacaaatgaaagaactatgattagtactttatctcctggaaattgttattgtgtgaattcaatatatataaatgatgagaaaacaccaatatcactttataaaaaattatttattatatctattttcaactcatttgtatttgactttttgttaagaagatttgttgattcaaatgtgctaaaatcatgcctttatcaatgcccaatgcctcaacccgaagaaaaagaaattttaagtaatcctttatatttaaatcttgcaaaaaatacttctttactgatagccaaaaatgatcccgaaaactttaaatatttactttacttagaatattttaagtttgataaagaaaaagttaataaaatactgaaactagataaagaagatgaattttttaaagaaaaagaaaatgaaaataattttattatagctagtctttactcattagctaaggaagattttatcaccttgcttggtgattttaaggcattaaagaataaaaaaaaaggagaagattatatttcttctttaataaaaggatatgataattatttactaaataataaaattttttatcataaa

SEQ ID NO: 369 - DNA, 834 bp, Borrelia burgdorferi sensu stricto
ttgaaaaactttaaattaaatactattaagcttaacgttattacagcaatattaactttaatttgcatatcatgtgcaccttttggcaatgttaatccaaacaagctaaaaaatcctatcacctctaaaaacctaaaaaaaccaaagcgaagcaaccattctagaaatctaaaaaaaacaaacagtcacaccaattcagaaaattcagcagaaaataaccaaaatcttgaaaatgaatctcaaaattcaaaatcttcaaatcaaaatcctcaagaagaaactgcaatctcaaaattagaaaaaattggtaaggacctggaagctcaaaaaaaggaaaaagatacacaaatagaaaaaattagtagtgatgctcaatatgattttctagagaattttaaacttcacaactatgattattttatgcataatacaaaaatgacattaaaaaaaataatttactcatccctaaattacgaaaaagaaaaaatattgacattaaaagaaattcttgaaaaacttgatacagaagataataaccgaagaatagctggtcaatttttagaaacatcaagggatattcaacttcaacaagaagatttgattttaaaaaaaatacaagatacattacaaactctaagcaaagaaaaagctgaagaattactacaacacgcagaacgcgatttaaagataaaacaaaactttgtaaaagctttaaacgcaactattgaggcttacaataaaaattctgataacattaaaatagataataaagcgctagcaaaccacatggaaaaaaaatactcccatcctctttatctactagatcaagctgat

SEQ ID NO: 370 - DNA, 1062 bp, Borrelia burgdorferi sensu stricto
atgaaaaaagttaaaagtaaatatttggctttgggattactttttggttttataagttgtgatttattcataagatatgaaatgaaagaggaatcccctggcttatttgataagggaaactctattttagagactagcgaggaatctattaaaaagcctatgaataagaaaggtaaaggtaagattgctagaaagaaaggcaaaagcaaggtttctagaaaagaaccgtatattcatagtttaaaaagggactctgctaataaaagcaattttttacaaaaaaatgtaattttagaggaagaaagtttaaaaactgaattattaaaagagcaatctgagactagaaaagaaaaaatacaaaaacaacaagatgaatataaagggatgactcaaggaagtttaaattcccttagcggtgaaagtggtgaattggaggagcctattgaaagtaatgaaattgatcttactatagattctgatttaaggccaaagagttccttacaaggcattgcaggatcaaactctatttcatacactgatgaaatagaggaagaggattatgatcagtattatttagatgaatatgatgaagaggatgaagaggaaataagattaagcaatcgatatcaatcttatctagaaggtgttaaatataatgtagattcagcaattcaaacaattactaagatatataatacttatacattattttcaacaaagctaacccaaatgtattctacacgccttgacaactttgctaaagccaaagctaaagaagaagctgcaaagtttacaaaagaagaccttgaaaaaaatttcaagaccttattaaattatattcaagtaagtgtaaagactgcagcaaattttgtatacataaatgacacgcatgcaaaaaggaaattagagaacattgaagcagaaataaaaactttaattgcaaagatcaaagaacaatctaatttatacgaagcatataaagcaatagtaacgtcaatcttattaatgagggattctcttaaagaagtgcaaggtatcattgacaagaatggcgtttggtac

SEQ ID NO: 371 - DNA, 972 bp, Borrelia burgdorferi sensu stricto
ttgggaggatttaatatggaattatttgatgaaaattattatgcaaaagctgtggcaaatattataggagaagttaaagatcctataatgtataaatggttttcgcctgatcaaattgaagatgttgatcttcagatgggctaccaaagaactgtaaagtgggatgcgtttttaaatgctaatcctacaacgattgctaatgaggttaatactatttcaactattggatttagttctgaagtggtaagacttaattacttaaaattacagtacaaatttaggcacttaaagcaggcgtctgaaaaattttacacttcagactcatatcttggtgacattaataacaatttacttcctttctctcaagcctataagcttgcaagtagcgagattattaaacttattaatcactttgtactaacaggcactgtttcaattcaaaaagatggaaaaaatcaaaaacgtctacttcccaatatgtatggacttcttaatatgccacatcaagtaaaagaagaagttgctagtggtgataaagataaaatggataaaatatttgaaaaaattgaggcgggactttcaaagttagagctaggagacgaattttctacacctatgatggtaatagttgaccctacaacttcgctcaaactcgtaaagccatacgcagcagcacagggtgcagcaagtagctgcgaaaaatgggaggatgttttgattcaaactatcaaggctattaataatagagaagatgtctacattgaaacttcaaacttgctaaaacatcaaatacttatttacccattaaacccagagcttattaagtttaaacctagcaagtatatgttacctacaccaaatgaacaagtggataaagattcaactgatattgctcattcatacattgattttgttttaggagggttacttgctactagaaaaactattttgcaagtacatattaaacaaagt

SEQ ID NO: 372 - DNA, 714 bp, Borrelia burgdorferi sensu stricto
atgaccataagggaaaattttatggaaacagtgtcaacaaatattgcaagtgtaactcaagaacaaatatataaagaatttattagactgggtatggaacaactaatagcacaagatttatctaaaagatattatcacaatgagctaacatatagagatttagaaaatttagaaaaacaatttgatataaaatttgataatcttatttttaagattgatagcgtagaaaagaatttacaaaaagatatatccaatttagacgttaagattgatactgtagagaagaatttaaatgccaaaatagatggtgtagagaagaatttaaatgccaaaatagatggtgtagagaagaatttaaatgccaaaatagatagtgtggaaaagaatttaaatctaaaaatagatagtttagatactaagatagatactgtagaaaagaatttacaaaaggatatatctaatttagatactaagattgatactgtagagaagaatttaaatgttaagattgatactgttaaaagcgaacttaatactaaaatagacaatgtagaaaagaatttacaaaaagacatatctaatttagatgctaaaatagataatgtagaaaagaatttaatgtctcttacagaaatgcttaaatgggtattaggaatcatgggagcaatgtctatcacaatgatagccgggctaatatttgctttcatttctaaa

SEQ ID NO: 373 - DNA, 561 bp, Borrelia burgdorferi sensu stricto
atgagcgatggtattacaaaaataaaagaagagtttgataaaaaagttgcagaaattaaagcattaatgaaaaatcctcagcaagatactggtttgcttagtaattctgtagattttagagataaaaatctaatttactccaattcggatggagtttttactagtagtaaagacaaaatagaaaattatcctgctaaagggtatccatacaagcgtggagtcaagcttagttttagtgcagatggtacaacagaactagaagttgaggctggtggtggggatgacttgtacggaatatgcactgatatagatgagtttactggcatggcaactgtagttccaattacaaataacttcacggggtatttaacatttaagaaaaatggaaatggtgtaaacccaggtgataagctgcattttaatgcacaaggagagcttgaaaagaatgggggaaatgataaatctgttaatgctatagcactttcaaaagtacataaattaaccgaagagttatctatagtgcttgctagtgtttttgggaatagagctttaaaaggtaat

SEQ ID NO: 374 - DNA, 1293 bp, Borrelia burgdorferi sensu stricto
gtgagcgacaaattcaccattaaatttaaaggtattcttgatcatgctgcaacaaaaaaggccattgaacaagatatttctaaaatggaaaaatatcttaaacctaaaaaatctagtttgggtagcactaaagatattgtaaaaaataatttgtcggacaagaaaaaagaacttagtagacaatctaaatttgaaagcttaagagagcgtgttgagaaatatagacttacacaaactaaaaaacttataaaacagggcatgggatttgagaaagctagaaaagaggctttcagaagatctttaatgtctgatagagacaaaaggcatcttgagtataaagaacttgcaaaagaatcaaaagcaaaaagtaaaatgttagcggcctctcaaggaaaaggacttgttgccaaaattgcaataggtagtgccctaaggaatatcattagcaacgctatgagtaaagttggaggaggccttttaggttttgctaaaaaagcagttgaagaagacaccaaaacaaaaagaacaaaacttctcaatagtgcattttttacagataacgaacgaaatatgattatgggaaataaagacaagaatactaagggaattcttgacggaatgaagggatttgagcgcgacttagaaaaagaagaattcttaaatcaagcaagtgtctttaagggtactttaagggacttagatatgttaaatgaaactaatttgaaaaacgcagtagaatttgcagctatgcttaaatccagtggtgctatgagcagcgaagatgcagtaaaggctgttaatagtgttcttgggggtgatggaagtgagctttttgatctattaaagaagtcaggtgttggagacaaatatatagaagatgccaaaatggcctggcaaagcggggctcaagtagatctagattccagaattaccaagatgatggaaatgttcaaggattttaaatctttcggccttacaaaaaaagtcaataatgctgaaagtattcaaagtaatttggcttcagctgagcaaactcttcaaaacttaaccaccactgtcttagacccaatacttggcctcgttaataagataactaaatactttgaaggctttaagtttgaaacacacattattaatcccataattgatggcattaaaagtatttttaatcttaattatttctttgcaaaattaaaatcgatgctacctggatggatgggcggagatgagggtgcggctctaaaaaaactacaagaagaagttcaaaatcaagacaatgctaacaacactcca

SEQ ID NO: 375 - DNA, 768 bp, Borrelia burgdorferi sensu stricto
atggagcaacttatgaataagaaaatgtttattatttgtgctatttttgcgctgatagtttcttgcaagaattacgcaagtggtgaagatgtaaaaaaaagtttagaacaagatttaaaaggaaaagttaagggatttttagatacaaaaaaagaagagttttttggagattttaaaaaaccagaagcaaaagttcaaccaaaggatgaagaatctatgcaagctgatgagcctcaggagcagggcgaagatcaagtggttcaaggtgttgctgaagatcaaaaattaaaagaagaaattgaacaaaaaataaaagaattaaaggataagatagagaagtcggatcctaaaagtgtttctcttaaaacatattctgattatgaaaaggaaatagaagaattaaaggaaaaactaaaagataaagaaaagtttgaaaaagaattagaaatccttgagaaagctttaaatgaaaaaatagagaaaagaaaaaaagaattagaagagtctcaaaaaaaatttgaagaacttaagggtcaagttgaatctgcaattggaataactgatggagaaagggctaaaaatcaagggaaagttggaatagaagccttgcggcatgctcggggtttgggctttaaaaatatttctagtggtaatagtactagcgatatagctaaagaaataatagtaagctcgcttaaaaagattgaagaagagcttgaagagcttaaaaagttagagaaagaatctaaagattctaataaaaaagaa

SEQ ID NO: 376 - DNA, 537 bp, Borrelia burgdorferi sensu stricto
atgagaaatttggtgcacagaacatatgatatagaaagcataaaaaatgaatttttaaacataggatttagtgaagaggcaatagattttgtttttcttcataatgataattacaactatgaggttttaaaagagaaaataattgatgtagaaaagaatttgcaaaaagacatatctagtttagatactaagatagataatgtagaaaagaatttaaatgttaagatagataatgtagagaagaatttaaatattaaaatagatagtgttaaaaatgaacttaattctaaaatagatagtttagatactaagatagataatgtagaaaaaactttgcaaaaagatatatctagcttgaatactaaaatagatagtgtagaaaaaaccttacaaaaggatatatttagcctagataataaaataaatgttttaaaaaacgaacttactgcaagtaatagaacaatacaagtaattttaataatgggaataacgcttgctccaattatttattctatattcaataagcattttttaaat

SEQ ID NO: 377 - DNA, 687 bp, Borrelia burgdorferi sensu stricto
atgaataagaaaatgaaaatgtttattatttgtgctgtttttgcattgatgatttcttgcaagaattatgcaagtggtgaaaatctaaaaaattcagaacaaaatctagaaagttcagaacaaaatgtaaaaaaaacagaacaagagataaaaaaacaagttgaaggatttttagaaattctagagacaaaagatttatctaaattagatgaaaaagatacaaaagaaattgaaaaacaaattcaagaattaaagaataaaatagaaaaattagattctaaaaaaacttctattgaaacatattctgagtatgaagaaaaaataaacaaaataaaagaaaaattgaaaggaaaaggacttgaagataaatttaaggagcttgaagagagtttagcaaagaaaaagggggagagaaaaaaagctttacaagaggccaaacagaaatttgaagaatataaaaaacaagtagatacttcaactgggaaaactcaaggcgacaggtctaaaaaccgaggtggtgttggagtgcaagcttggcagtgtgccaatgaattaggtttgggtgtaagttattctaatggcggcagtgacaacagcaatactgatgaattagcaaacaaagttatagatgattctcttaaaaagattgaagaagaacttaagggaatagaagaagataaaaaagaa

SEQ ID NO: 378 - DNA, 450 bp, Borrelia burgdorferi sensu stricto
atgaaaatcatcaacatattattttgtttatttttactaatgctaaacggctgtaattctaatgataatgacactttaaaaaacaatgcccaacaaacaaaaagtagacaaaaacgtgatttaacccaaaaagaagaagtacaacaagaaaagccaaaatctaaagaagaactacttagagaaaagctatctgacgatcaaaaaacacatcttgactggttaaaaactgctctaactaaagatggagaatttgataaatttttggaaaatgatgaatcaaaaataaaaacagtacttaatcatataaagagtgaacttgataaatgtactggggataatgcggataataataaaaatactttcaaacaaacagttcaaggggcacttgaaggggacatagataaatttacagagcagtcagatagtacatgtggtggtggtaattcctaa

SEQ ID NO: 379 - DNA, 549 bp, Borrelia burgdorferi sensu stricto
atgaggattttggttggcgttttcataatagcagcattggctttattgggttgttatttgcctgataatcaggaacaagctgttcaaactttttttgagaattcggaaagtattgatatgggttccgatgagattgttactgaaggcatattttctagtttaaaattatatgcgtctgaacatcgtttattggttgagataaaaaagactttaattagtttaaaagatcctaattatcgtgatgtacccccagtgcgtgactataatgaggagtattttaataaattctttttagatttaggttctgagcaatctaaagacttgattaagttgtttggtagggtaaaaaatgagcagaataataaatttaaaagtgaagtttattggctgtattcatgtataagcgagttatattctccagatattaagtattctggcgaagaggggagccctgagtatgatcgttttatgcctagacccactgcttatcaacaatatttaaaagtgaagagagaaatagaaagaaatacaattaatggaaaaatttta

SEQ ID NO: 380 - DNA, 333 bp, Borrelia burgdorferi sensu stricto
atgcaaaataacactattggtttaggacttaatttactatccagcttaactaacatagctaaaactgatacaaacatagatcataattacattaatacttttagtaaagtaatagattttttctacaaaacatatataagcacactaaaatctatggaaacagctgagtcaactaaaatatttgaagaaatacaagacattttaaaatacaacattgagataatagaggctatctctactgataaaagcaaaagaattatcacttcacttaaagcaacacgtaacaaaatcatgaaagaatatatcaaaatacttaaaagaggtgaaaatgct

SEQ ID NO: 381 - DNA, 627 bp, Borrelia burgdorferi sensu stricto
atgaccataagggaaaattttatggaaacagtgtcaacaaatattgcaagtgtaactcaagaacaaatatataaagaatttattagactgggcatggaacaattaatagcacaagatttatctaaaagatattatcacaatgaactaacatatagagatttagaaaatttagaaaaacaatttgatataaaatttgataatcttgtttctaaaatagatactgtagaaaagaatttaaatgttaagattgatgctgttaaaagtgaacttaataccaagatagataatgtagaaaagaatttacaaaaagatatatctaatttagatactaagattgataatgtagagaagaatttacaaaaagatatatctaatttagatactaagattgataatgtagagaagaatttacaaaaagatatatctaatttagatactaagattgataatgtagagaagaatttaaatgccaaaatagatactgtagaaaagaatttaaatgccaaaatagacaatgttgaaaagaatttaatgtctctttcagaaatgcttaaatgggtattgggaattatgggggcaatgtctatcacaatgatagccgggctaatatttgctttcatttctaaa

SEQ ID NO: 382 - DNA, 276 bp, Borrelia burgdorferi sensu stricto
atgagtaatttagcctacaatgctcttaaaatagaaaatataaggttagaatttttaaataaggggtttagtgaagaggcaatagattttgttttacttcagaacgacaattacaactttgaagttttaaaggagaaaatgaattctttagaacaacaaataattaatgtagaaaagaattttcaaaaagatatagatagtgtaaatactaaaatagatagtgtagaaaaaactttgcaaaaagatatatctagtctagacaataaaatagatatt

SEQ ID NO: 383 - DNA, 558 bp, Borrelia burgdorferi sensu stricto
atgagcattaaaaataaaatgataataaccaaaagaatagatataaaggaaaatatgtctaaaatggagtcattagaagaaattcataaagaagaatatttgagattaaaagacaaattaaaaactctaacaacggatgatatttataataaaatagaaacagcaaaaatattaaatgcgattaatcaaaaaaaactgtatattttagacggatataaaaatttttatagctttttagctgattttaaaatcgctaaatctcaagcatataaatatataaaaatagtatcgggcgtagaaaaaggtattattgactataattttattgctaataatggcattgaaaaaacaattaaacaattggaaagtaacaatgttattaaaaaatctaggcaaaatccaataaagcctttaaggtttcaacttaaaaagcaagaaagttatgatttttataaaaaaaatgggaagtttactgggtttttattggaagaacttcttgaaagtcaaacagatttgattaataagcttttaaaaaaatataaacaattaaaaggatat

SEQ ID NO: 384 - DNA, 540 bp, Borrelia burgdorferi sensu stricto
ttggatattaaggttaataaaagagatttaagtgataatgaaaattatattattactgatagtgtattaaatcattataattctttaaaagaaaagttaaaaattaattctaaaaaggaaatctattgtaagttagaaactttaaaaattttaaaagaaattaaagacaatcattattataggtttgatggttataaaagttttgaagctttttctaaagattatagacttgcaagagcacaggtctataattacttaaaaattgctaatgcaatagaagatgggattatacaagaagaatttctaataaaaaatggtatactggaaacgttaattgtattaagaaataaagagagcaaaacaataaaaaaatcaaaacaaaacccgataaagcccttaagatttcagcttaaaagacaagaaagctatgatttttataaaagtaatgctaaatttacaggatttatgttagataaattatttagtgatggaaaagaaataattaaaaaacttatgaaagaatataaagaattaaaagga

SEQ ID NO: 385 - DNA, 486 bp, Borrelia burgdorferi sensu stricto
ttgtttacaagtagccaagtaagttttcaaattctttttcagattaatgacaaattcttctatgtgcttcatctaagtaattttgcagactcctttactaaatcgcttgtccagtttgtatattggtttttaggttttctcttcttcaaagatagccaaatgggtactgctgaggattctatacccttatatgctgcccaacttttgatttttgttagacttggagctggcaagttgttgttatatgcctgtcctgagtctagaaattcagaaagaggggagcctacctttacttttaaattaattcccaaagaagtttcttctaaatcaatatttgttacattcgacaatcgtccggggatatgtgattttaaggagtccgacttttgtcggattttaaaaccaacgaaactttttgcattatcaaatatagattttcttattttttctccaatttccatttgttatccttttggtcaaccaata

SEQ ID NO: 386 - DNA, 552 bp, Borrelia burgdorferi sensu stricto
atgaggattttggttggcgtttgtataatagcagcattggctttattgggttgttatttgcctgataatcaggaacaagctgttcaaactttttttgagaattcggaaagtagtgatatgggttccgatgagattgttactgaaggcatattttctagtttaaaattatatgcgtctgaacatcgtttattggttgagataaaaaagactttaattagtttaaaagatcctaattatcgtgatgtagtacgcccagtgagtgactataatgaggagtattttaataaattctttctagatttagggtctgagcaatctaaagacctgattaagttgtttattatggtaaaaaatgagcagaacaataataaatttatgcgtatagttcgttggctgtattcatgtatagaggagttatattctctagatattaagtattctggcgaggggagccatgagtataatcgtaatatgcctagacccactgcttatgaacaatatttaaaagtgaagaggtatgattataatagcccagtttctattttacctaca

SEQ ID NO: 387 - DNA, 543 bp, Borrelia burgdorferi sensu stricto
atgcaagaacaaataaatgaagaaactgttgcaatttctgaatctttgccaaaaaatgacaaagaacttgtaacaatatcttcagaagaatatgaacgattagtggctgatgcaaaaaaattgccagacatgatatcacgagaagatttcgaaaaacgacttgctgaggctgagagcaactttataaaagctcgaaaacaagccgaaaggcaagccgaagctaatgctttcaaagattctaaaattttgtcaaatcttgagaaagcttgtgagcagtatgaaattgctccaccttttgctaatgttctgagcgtaaaagacgctaagcttgcatttttggatgcaatgaaaaaaaagtacaacatcaagttcaaaattgacgaggaaggtgaccttgattcgcaaatcgacaatatcagcttgctagtacaagaacttacagcgtacaagcaaatggtaaatgcaagaaatcgatttacaggtcaaattattaacgagacaaaattacaaaaatacaaagatagatttgctttggggagggca

SEQ ID NO: 388 - protein, 656 aa, Borrelia burgdorferi sensu stricto
MNFNWFLMLFLFNFSVLLGSDTTALGHYQRANEYYLSKRYYDAIDELVEAIKINPNYYEAYKFIASIYYSLKIYTQAQFFIEKASKMSNEDTEYKILYANILLKNDKIDQAKKIYSEVLVKQRNNIDALVGLASIFEKNGLFIAAANYYLSILDYSQNNYSAFEHLIDIYQRLGMHDKIRHLINKVRVNFLSFPDFHKRVAEFYISINNLGLAEKYALNYLALIESSYKDFGVVDAYRLLALVYLHEFKYEDAIEALQKAILVNKDSDELYYLLGYSYLRFGDIEKAILNLERAKNLKKDLEFYNIALEESFFASNFRNFLKNNSNARISKHYENEGLKAFKSLNLNKALFNAKNAVDIWPDNDSARFLLSKIYKLMNLDIMAYEQLFYLAKQRNSTDSRILDFYDVVSFDVRKSLFYKYGYKSIADFNKLYDDRVVYKMAIFTQSENKFFGANDLILRYAERVLERNLNMEIVNYNFDYNKNRDYLINNFSEGFSYSRNNNLDLFLIFDFKADILKNTATLVVNIFSGKTGIKLVSFSYDVGGVNYLSNALNSLSKDFHDYLPKKGKILQIKNDDALINLGQVNGVVKGDVFLILKEGALNSDTRDSGFIVYKKSDILGEILIEDISDYISRGIVKSSTFLKDYVQEGATVLIKR

SEQ ID NO: 389 - protein, 238 aa, Borrelia burgdorferi sensu stricto
MNLMLITFNEFKTGISLNDTRAEHLVKILKLKDNDKFKFGILGEKNIYHCIYKKDKKLFFKKIFKVGESNKLKKLYVLIGMIRPIVAKRIIKELASIGTYKIIFFNTELTEKSYLNSKIFKNNDCEKHLIAGAMQGKITYLPKIKIIKNLKESLKYIQQENFEIKILLEKNSEKNLIDIEQINNAVIIVGPERGFTEKEKQLIAQYNFSPYSISTNTLRTETATIAASIITASKLINM

SEQ ID NO: 390 - protein, 312 aa, Borrelia burgdorferi sensu stricto
MKIFFVSSSSIALEVFKEIVKHYEVVGVLTLPDRPKGRGQKLSQNVIKSEAIARNIKVLDPLILDDNVLNLVRDLNPDLMLVFSYGKIFKKEFLDLFPKGCINVHPSLLPKYRGVSPIQSAILNGDCVSGVTIQSMALEMDSGNILVQKNFKIRSYDTSHDISKLVSSLSPSLVLEALEKISKGFLGIPQKSSEATFCSFLKKESGFIDFNLSAFEIKNKINACNPWPLVRVRLDYNDIIFHRADFLEVDLYKERKIGEIVDFNPEKGLFVNTGKGILLLLEVQRPGRKVLDFKSFYNGSRQLIGQVFSSIE

SEQ ID NO: 391 - protein, 348 aa, Borrelia burgdorferi sensu stricto
MPKTFGGSFDKNEIQAKIEKYEKEINQKNFWNDPKRAQKVIKAQSILKNKIDPWEELINKIKDLSDLCEIAENEKDTNGLEIEFNTLEKQYKDLLTISYFKEELDANNAFLTIHSGAGGTEACDWVAMLYRMYSRYAERKKYKTELIDLLEAEGGIKSVTIEIKGEYAYGLLKSEVGIHRLIRISPFDAAKKRHTSFASVFVDPVIDDKIEITIKPEDIRIDTYRASGAGGQHVNKTSSAVRITHIETGIVTQSQSDRSQHKNKDLAMKVLKSRLYEYYKSKEDEKNKSKQDTKKEISWGNQIRSYVFQPYNLVKDHRTKFENSNTTSVMDGNIDNFIEEYLKWKSLN

SEQ ID NO: 392 - protein, 342 aa, Borrelia burgdorferi sensu stricto
MKKKQLILLLFMPQIIYAKSYFASDVFFNKYQKLNEKPKTGFYIEYYSVDDTEKLYLYKENNLIKYKTIQIIENTKKITCYDTKDTKRKEEIYDNLNNKIQEIEYDSKGKTLETANYVYENENLISKNLKTINQKPKLIYYSKDDNGKLLKITGSNFQIWNYGINGDIKSTYFDIKKATTKVIKYDDKKRNSNSTIIVNNKIKSKEKNQYLDEEKIVNTFEEENTKIISTYKANNLIKEETYKNNELIKVNDFQYNESDMIIFQNTKEKDKDQYTNTKIEYEYNKDNQLKSKKIYENDIIYLKTEYHNDNEYEEEIYYNKKPALRVKHKNGKVTEEKPIGTN

SEQ ID NO: 393 - protein, 416 aa, Borrelia burgdorferi sensu stricto
MILRLPEITKIAYLIFKNSTNKIALIGSGISLSLVMIPLIIVYYMSSNIMTSTINKYIESEGFSMQIEYNETNRTHYLKDRLSLLKKKHNYKDLNYFFEKRTYGIIGNNKKQGVLIRAIENKFILENKSIKLIKGTKNLKKDSILISNQIKNKLNLNLNEKIDILIPNTKNDKIMPRIKKFNISGIIETGLKDIDNNLVLISFENENLMSKKFSKSIIGLKTNSNSIKNNEILKQNLETEFQEFQIKTFYELYSNKYNNLDISKKLLIFIMALIIIFASINISSSLSMLIFENKKKIAILKSIGMNNLNIKIIFLLISLTLSTIFCGIGIIIGNYLTLKISYLINFIDNILNFFLKIFGEENSEILNSEYYVSEFQIHLSLSFSLTLLGLYMLINILTTLIPLNIVSNLKEKEILR

SEQ ID NO: 394 - protein, 144 aa, Borrelia burgdorferi sensu stricto
MDIGLIGVNSALTISAIGSALGMGAAGSAAIGAWKRCYMQGKPAPFLLIVFVSAPLTQIIYGYILMNTLYEVMMQTNPWLLLGAGIGGGFAIAVSGFAQGKAAAGACDAFSETGKGFATYLLVLGLIESVALFVMVFLMIFKFV

SEQ ID NO: 395 - protein, 551 aa, Borrelia burgdorferi sensu stricto
MNEVLFVKTAGRNLKAEVIRIRGNEVDAQVFELTKGISVGDLVEFTDKLLTVELGPGLLTQVYDGLQNPLPELAIQCGFFLERGVYLRPLNKDKKWNFKKTSKVGDIVIAGDFLGFVIEGTVHHQIMIPFYKRDSYKIVEIVSDGDYSIDEQIAVIEDDSGMRHNITMSFHWPVKVPITNYKERLIPSEPMLTQTRIIDTFFPVAKGGTFCIPGPFGAGKTVLQQVTSRNADVDVVIIAACGERAGEVVETLKEFPELMDPKTGKSLMDRTCIICNTSSMPVAAREASVYTAITIGEYYRQMGLDILLLADSTSRWAQAMREMSGRLEEIPGEEAFPAYLESVIASFYERAGIVVLNNGDIGSVTVGGSVSPAGGNFEEPVTQATLKVVGAFHGLTRERSDARKFPAISPLESWSKYKGVIDQKKTEYARSFLVKGNEINQMMKVVGEEGISNDDFLIYLKSELLDSCYLQQNSFDSIDAAVSSERQNYMFDIVYNILKTNFEFSDKLQARDFINELRQNLLDMNLSSFKDHKFNKLEHALGELINFKKVI

SEQ ID NO: 396 - protein, 398 aa, Borrelia burgdorferi sensu stricto
VIKKVAIIDGLRTPNFKFGGSFKGLNIIDESSKVVKALLERNKLYKVDEVIIGNVISAGLGQNIARQIALKSDLGDTVPAFSVNKVCGSGLKALELAFNSIALGDNDIVLAGGVEDLTNSPYLLPRKIRFDGLKFGNFGIEDSIQKDALIDSLNFISMGLTAENLSEKYRITREMQDEFAYNSHVKALKARELGYFEDEIYPLTVFDKKTNSSVTISSDEEIRDNLTLNKLASLNPVFKESGTVTAGNSSSLNDGACFLILASEERVKSLGLSPLAYIGGFKSVGLDPLYMGFGAYMAIEGIISKLSLNPSEIDLIEVNEAFAAQALSIEKALFKKYNITSDIINVNGGAIALGHPFAVSGSRILLTLSRSMKMKNKTKGIASVCIGGGQGISSFLYR

SEQ ID NO: 397 - protein, 553 aa, Borrelia burgdorferi sensu stricto
VRMENQKDLQENYLKVLERVELGSRVSGTVVNIMKDYVLVDIGYKSEGFIKIEEFENVPQVGDRLEAIVVRIGGELGLILSVEKLNSLNFQDKVYEYIQNKKIIKGKVLVELPNGYKIQINENVSGFMPFYLSSKSKDEKLKRGSVVEFYILEASEADGLRLILDRRTLEKERDLAKRIELVSSYNEEDVVDGVVERITEYGAIVKIKNFVTGILHKRNIAFNQVENVEDFVRVGDKLKLKIIKINPQTGKMELSLKALKANPWDSVDVKYKIDSIVKGKVVKILPFGAVIELDSELSGFLHISNFSWIRVVKSPQELIKLGQIVEVKILEIDKENQKISLGIKQINENPWERLTEKYPIGRVVQGVVTNITKTGAFVNIEEGIDAYVSKFDISWLEEIDPEEYFKIGDLVNGKVLEVDKRKRNVRLGIKQLEESPWEDFSKSYKKGDTIEVEIVEKKSKGFQVRVYNKIMGFISKIQLGDTKESSLETFEKLNVGDKLKVVITSIDSKDKSVLLSYREYENQRSREEISSYLFKGNDEESYKPFENLLKRDE

SEQ ID NO: 398 - protein, 629 aa, Borrelia burgdorferi sensu stricto
MTKRMLNNTYRIKTILTIFLAITLLTIYKYFTLMAFNNSPDNTISLKSNDIAKRGTIYDRNGKPIAFSSKSYSIGTNPQKIENIVSTSETLGAILQINSRILKEKLSSNKGFLYIKRKIKREESDLIKRIQAEGRLSNITLYPDYTRIYPFRNTTSNITGFVGTDNLGLEGIEFSLNSILGKDKTKQQFLNEEPETNNIHLTIDMDIQQGVSKIAKKYFKENNPESLITLVMNSQNGEILSMVQFPQYDANFYSKYPEEIRKNLSSSLTYEPGSINKIFTVAIILESGKLNLEEKFLDNGIYQKQFPSGEKITIKTLNPPYKHIDSTEILIYSSNVGIAYITEKVSNEYFYKKLLDFGFGEKVGVPFPGETKGLLNHYSKWSGRSKATIGFGQEIGVSAVQILQAASILSNNGIMLKPRIIKKISNDKGENIKEFDKEEIRKVISKNSAQKVLKMMREVVNKGGIPNLKIKNLDISAKSGTSQAIDRKTGKYSEEDYTSSILAIYPTEQPKYIIYIVYRYPKKIIYGTRIAAPMAKEIIEFIEHQQNTIAYKKIKMPSKIKIPKAETNYKNKTYLPNFINLSKREAIDILKYYKNTMKIKINGDGFVYKQSISPNTKLEDITELELYLK

SEQ ID NO: 399 - protein, 336 aa, Borrelia burgdorferi sensu stricto
MIINHNTSAINASRNNGINAANLSKTQEKLSSGYRINRASDDAAGMGVSGKINAQIRGLSQASRNTSKAINFIQTTEGNLNEVEKVLVRMKELAVQSGNGTYSDADRGSIQIEIEQLTDEINRIADQAQYNQMHMLSNKSASQNVRTAEELGMQPAKINTPASLSGSQASWTLRVHVGANQDEAIAVNIYAANVANLFSGEGAQTAQAAPVQEGVQQEGAQQPAPATAPSQGGVNSPVNVTTTVDANTSLAKIENAIRMISDQRANLGAFQNRLESIKNSTEYAIENLKASYAQIKDATMTDEVVAATTNSILTQSAMAMIAQANQVPQYVLSLLR

SEQ ID NO: 400 - protein, 665 aa, Borrelia burgdorferi sensu stricto
LASGFFVPGLESKYNTKEIRESMLKSDKAKIDSSFKKLESLEQEKSAWQLINRKISTLNSLAKELTSLNSPFNLMSGNSSNSEVLTLSTRYGSKNETHKLIVDQIASADVFLSSNFDPKKVTIPEGDYIFLVGKKEINVKSNGNIDLLVKDINNKGKGFLSAKIVKSDKNGNSRFVLQSLKEGKENKLVIKGEGLSFAKQIGILSELKTNFNPNLSDIVVNQSSSNNKLAFENNGLVLNPLSEVSIEIPEDIEITSRSKIKFEVKYFDTGLEEPDSKIIFNPGGATFKDAKVESEDSVVDLGSDLKTPLEKKYIQMNMVKICSKEGSLELPLINISNNFEEVEVDVGALSNLEEINIENKANNKVIVISNVEIFDPKNRDGHLPINAKSFAENAKIKFDGVDVERDSNVINDLVPNVTLSLKKPSSDMVEAKIEPDYEGIKRVLLDFIGAYNEVLAEINIVSSNEDQPNNQKSNIVEELTYLSDSQKEEAYKNLGILRSEFLLKNLKSKLESIIFKPYVTSDPNFSIINQMGVFTNSISSSGGLSRYLRLDEKKFDESIRNNIDNVRELFLYDLNGDRVYDNGIAKMLGDCLSPLVASGGVIYNKIKNYDLKIFNQKNKVEDYKKKYEDRERKVEGELNTLDFTVKRMKDQENTLKAFDFNQRNK

SEQ ID NO: 401 - protein, 401 aa, Borrelia burgdorferi sensu stricto
MPNFCLFNSKSVLTGNDKIDNSAVLIKDNKIFDIVTSDRLKKMDLEEYQMIDTKGNYITPGLYDNHIHGFHGHGTDQCSTESILKMSEHLAQYGVVGFLPTLYPRPIDEMIKTIKACIAAIGKEKGAKILGLHLEGPFFSPEKKGAHPVSYLHEPSIEVMQKLIDAAGGVFTGSNGKRKTHISTMTVAPELKGMRELAIFCLENNINLQAGHTNATYENMIEGFQVGILHTTHFFNAMSKLDHRNPNAIGAVLIHGDVSCEIIADGHHIHPKLILMLRKLKDISKIVLVTDGLTPNCQTCGKLIANGDEVYIAEDGLFHSVKSNTIAGSTLTMIQGLKNLIEFGFSLSDAVQASSYNPTRILNIDKKGLICHGYDANLNVLDKDFNLKLTMIESKIIFNNL

SEQ ID NO: 402 - protein, 627 aa, Borrelia burgdorferi sensu stricto
VDSTFSGIEIGKRSLFAHKDAMNTVGHNLSNATKPGYSRQRVTMKTEIPLYAPQLNRAKKQGQLGQGIVVQSIDRVKDELLNTRIIEESHRLGYWTSQDKFISILEDVYNEPEDQSIRKRLNDFWESWHDLANQPQGLAERKIILERGKSFCEGIRNRFHSLERIYIMANDEIKITTDEANNYIRNIANLNKQISKSQAMKDNPNDLMDARDLMVEKLGNIISVSIENKQDPNEFLIHAEGRHLVQGSIANEFKLEATNGPTRTRWNILWANNDKAYLKTGKLGSLLNIRDEEIKNEINELNNIAANIIEIVNEIHEAGRGMDKKNGRSFFSQELKLTDDRGRYDTNGNGQFDSVHIFKINSTNEIFPEEKLGFYGTLKFEATNSNEIVEIPYNAPDTVQDVINRINNSNAQVTARINSEGKLEIKAVKEQEDENITFKIKHIEDSGSFLTKYTGILNASGPEGAYDYKNIDTTDKLAPKSTYSISPLKNPAAWIKVADIIDSDPSKIASGIKNPTNEISIGDNQAALRISSFGNSQIMIGKNLTLNDYFANTASNIAIKGQISEITKESQSQILKDLTDLRMSISGVNKDEELANMIEFQQAFIAASKFITVSVELIDTVINKMGV

SEQ ID NO: 403 - protein, 246 aa, Borrelia burgdorferi sensu stricto
MSGPKKLAIIALLVISIQGCKESSIIEKQFNYAIIFSDATEYFFEIQTTPFIKNEILFINDKNLEIIKDKLKTTKKILLTHKSNNEILNNEILKEKIFYLSKIKFSLKKSIDFLLNEKSIDLQKTLLFRDKSLNNEDLEYLEKKGKEKNVNITLINEKNISYIQTFITSQIKTIILFSLRDNNIILKKILNSPFSKNIKFVLIGNTRKDLKIIKLKYIITLKEPDLIKIAKDVEKDFQYEFNIYKQ

SEQ ID NO: 404 - protein, 356 aa, Borrelia burgdorferi sensu stricto
MLIFGGVSFEHEISCKSAYSIYLALLDLNKYNIYPVYIDKCTGVWYLLDSVSDPPKPINTDVLPIVSLLPGFGIFSNNKNLEIDVVFPVVHGRTGEDGAIQGVLKVMDIPCVGAGIIGSAISSNKYFCKLLLKSFDIPLVPFIGFRQHDYFLDKEEIKRNVKEVLGYPVIVKPAVLGSSIGINVAYSENQIESFIKEALKYDLTIVIEKFIEAREIECSIIGNEKMKIFSPGEVVVQDFIFYDYDAKYSVIPGNSIIFNIPAHLETNQLLSIKEYAFLTYKNLELRGMARVDFFVEKKSGTIYLNEINTIPGFTDISMFAKMCSNDGLQFKDLVDNLIDYAFQSYINRKKRIDFEN

SEQ ID NO: 405 - protein, 1119 aa, Borrelia burgdorferi sensu stricto
MNKKHTNFSVLLLLIFLLILSFGGFGYYIYQSKLNDKNREIMLNEVKNSVIDRNYKKAYSVAKLLQDKYPQNEDIAMLTNTLAEIANSSPFESKDLQRDSANQILDKIKGQDNTKTNVNENFDIAFNNRYIKDSTITENYSDRNDDVGIEDEDISEFKKSKIPEKIKPNTNPKEEDQIIQSPNPKLSVNDQKNLFNLEKLKKNLSGKSNSENILNDSQKIENDKQNTNLSKEKNSENILKTPDNSKYSNNNNTTSLKKISSNSQKESELSPPSQTIIGKIYRPYSYLIKKELYEILDDINTGRVTLGKNRLKELIKKGLSNKFQKVNELIENSKNKEASNLLLTLIKKDIEPNLINIPKDPYKKEIFQLDKEDKKPQYLEDLKSKVHSIKPIDLENTKSRQQAIKDLNEFLKNNPNDAQASKTLAQANKIQHLEDLKSKVHSIKPIDLENTKSRQQAIKDLNEFLKNNPNDAQASKTLAQANKIQHLEDLKSKVHSIKPIDLENTKSRQQAIKDLNEFLKNNPNDAQASKTLAQANKIQHLEDLKSKVHSIKPIDLENTKSRQQAIKDLNEFLKNNPNDAQASKTLAQANKIQHLEDLKSKVHSIKPIDLENTKSRQQAIKDLNEFLKNNPNDAQASKTLAQANKIQHLEDLKSKVHSIKPIDLENTKSRQQAIKDLNEFLKNNPNDAQASKTLAQANKIQHLEDLKSKVHSIKPIDLENTKSRQQAIKDLNEFLKNNPNDAQASKTLAQAYENNGDLLKAENAYEKIIKLTNTQEDHYKLGIIRFKLKKYEHSIESFDQTIKLDPKHKKALHNKGIALMMLNKNKKAIESFEKAIQIDKNYGTAYYQKGIAEEKNGDMQQAFASFKNAYNLDKNPNYALKAGIVSNNLGNFKQSEEYLNFFNANAKKPNEIAIYNLSIAKFENNKLEESLETINKAIDLNPEKSEYLYLKASINLKKENYQNAISLYSLVIEKNPENTSAYINLAKAYEKSGNKSQAISTLEKIINKNNKLALNNLGILYKKEKNYQKAIEIFEKAIINSDIEAKYNLATTLIEINDNTRAKDLLREYTKLKPNNPEALHALGIIEYNENNNDQTLRELIKKFPNYKKNENIKKIIGI

SEQ ID NO: 406 - protein, 280 aa, Borrelia burgdorferi sensu stricto
LMKKVIILIFMLSTSLLYNCKNQDNEKIVSIGGSTTVSPILDEMILRYNKINNNTKVTYDAQGSSVGINGLFNKIYKIAISSRDLTKEEIEQGAKETVFAYDALIFITSPEIKITNITEENLAKILNGEIQNWKQVGGPDAKINFINRDSSSGSYSSIKDLLLNKIFKTHEEAQFRQDGIVVKSNGEVIEKTSLTPHSIGYIGLGYAKNSIEKGLNILSVNSTYPTKETINSNKYTIKRNLIIVTNNKYEDKSVTQFIDFMTSSTGQDIVEEQGFLGIKT

SEQ ID NO: 407 - protein, 408 aa, Borrelia burgdorferi sensu stricto
MKVMQDPRLSKYKNAKNLSKKTVEEIDTLSLNKNFSDSEIQGSMLRSWISLIKGNKNKTPVEPKSNNINELKPGFIRKESKVTKIAKYFLAIGLEKSAKIMSELDDSDIILITREISKISYIAPEEKEHIIKEFEELLRNQKRYVKVDDNFAYELLNKTLGKSKAKSIYKKVTGNDIFIPFDYLSQIEHEQLWALIKDENIKTLVILYNYLNKDQKKYVFSMLEEEDRRKFVKDLVKPRQLSMETIEAISNKLKDRFKMQGNLKTDKLDGSKILVDILSYMDFNEEKNLLNNINMRDLNPVVDSEIREKIFDINVILRIMDNDLHNILREFTDKEIAIIIKDKADEVRDKMLSNVSKRRKEIILDEEAFLGKISKKDLKTMTTAFVNYIKNLTLKGDLIIYRKNEEFI

SEQ ID NO: 408 - protein, 668 aa, Borrelia burgdorferi sensu stricto
MLIFGFIGLFFLNIFSLHAQGIVTNKDAQEEFKWALNSYNNGIYDDALLSFKKILSFDPNNLDYHFWTGNVYYRLGYVEEALMEWRNLKDQGYKVPYLRHLISTIEQRRGIFSNYELNFKKLVKVASLDNSIYKRPHGYQITSLRADKYGGYYAANFVGNEILYFDVNNNVNALVKDGFSYLKSPYDVIEANNLLYVTLYSSDEIGVYDKVLGVKRKSIGNKGTKDGELLAPQYMAIDKRNYIYVSEWGNKRVSKFGLEGDFILHFGSRTSGYKGLLGPTGVTYLNENIYVADSLRNTIEVFDTSGNHLYSVFTSIEGIEGLSSDFVGNNVIVSSKDGVYKYSIAKKTITKILKADKMNSKISSSILDANNQMIVSDFNNAKVSVYKSDASLYDSLNVDVRRIIRLGGPKIYVELNVSSKSGLPVVGLKSENFSISNENYYIVNPKVAYNVNASKDINIAVVFDKSSYMKKYDTDQIVGLNALMELSKNKNFSFINATSVPIIDNIESLTNSIRNTSSLGPYSTDAVKTDVSLKLAGSGLMSKSSRRAVVYFSGGILNRKAFEKYSLDTIVSYYKNNDIRFYLILFGNDPINSKLQYLVNETGGAVIPFSSYEGVSKVYDLILEQKTGTYLLEYYYPGPQEPNKYFNLSVEANINQQTGRGEFAYFIN

SEQ ID NO: 409 - protein, 262 aa, Borrelia burgdorferi sensu stricto
VLMEVLMRRLFLLYILCSFVFLNLFAQGSSSYIDKQKELAIFYYEVGQRYINVGKIKKGKLFQAKALKIYPDLKKGFDIKLAVKELDARIKDDNPKVVMLEDIKLEEIPGIVHEKIEINDFTNAPKIEYIAQRERSKNQDKIIKFQFGKFARALISRNFDLFDSVIADKVNVMGQFESKNDFISTLSSASSKADADELEYLSVDDYYDLKSLKISKSNDTSFAVNVNAKKNDVTKNFPFWKERQTLIFTTEDDNNWFLSSIN

SEQ ID NO: 410 - protein, 442 aa, Borrelia burgdorferi sensu stricto
MMRSLYSGVSGLQNHQTRMDVVGNNIANVNTIGFKKGRVNFQDMISQSISGASRPTDARGGTNPKQVGLGMNVASIDTIHTQGAFQSTQKASDLGVSGNGFFILKEGKNLFYTRAGAFDVDSDRHLVNPANGMRIQGWMARDLEGEKVINTASDIEDLIIPIGDKEGAKSTKNVTFACNLDKRLPLIQEGANPADIARGTWVVNKSLYDSFGNVSVLELRVVKDLNTPNLWNATVLINGEQNSNFTLGFDNEGALASLNGQPGQKGDILQIPITFNVLGANVGEVGEQQTVNLKLGTVGSYTDSITQFADSSSTKAIIQDGYGMGYMENYEIDQNGVIVGIYSNGIRRDLGKIALASFMNPGGLAKSGDTNFVETSNSGQVRIGETGLAGLGDIRSGVLEMANVDLAEQFTDMIVTQRGFQANAKTITTSDQLLQELVRLKN

SEQ ID NO: 411 - protein, 455 aa, Borrelia burgdorferi sensu stricto
LCLRRLKMNKLEEHYIVPKDVVAELDKYIIGQDEAKKLVSIALVNRYIRSRLPKEIKDEVMPKNIIMIGSTGIGKTEIARRLSKLIKAPFIKVEATKYTEVGYVGRDVESMVRDLMSIAVNMVKEEMYSTVRDDALVRTEERIVDSLFKGSSNSENMDPNEIKAEEKVKEKLRKKLRAGELDDTTIEIQISSKMPFSTIEIFTGGNFEEIDMGIGGLLGNIFDRKKKRELKIKKAKEIILAEELEKLVDHENISDIAKSKVENMGIIFIDEIDKIAAKNRSGNDVSREGVQRDILPIIEGSKVNTKYGIVDTSHILFIAAGAFNLAKPSDLIPELQGRFPIKVELKSLSIDDLKKILKQTKNSLIKQYVAMFKVYDLDLKFSEEAIDRIAELTFNMNLESENLGARRLHGVMEIVLADLFFEVPGSKLKKFEINLDYVNKKIQINEQKDLNYYII

SEQ ID NO: 412 - protein, 228 aa, Borrelia burgdorferi sensu stricto
MRKITIMILFYGLIINVCPTTTTSILKLNKKANKHTIEKLYQKSMLLKDSKKYNKAIESLTKIINMDQNQADAHLLLSELEYLNKNWKKAIIKSQDYLKIIDFKDKKNFLDISWAYFLIGEVKNSMDYIIKFFQSGKELFRENIFIAIDALFKKSIYHFTNNENAAFNAILSSTFQLALNDDTLFIIFLNNLEIIKQIPFYHFNRKKLEELYLQISTLKTIQNTTCRT

SEQ ID NO: 413 - protein, 377 aa, Borrelia burgdorferi sensu stricto
MNIKNKLISLLIVVAISFIACKTPPESRESKNAKIAQPDNKNFQLRDIKDIKNELIRERGHLFYSKEFNEAERLEEAMKQSFSKKKAIEGNEIALKVLERYKTIIRETREKKEKTNYLKENIEKYLNDAEANEAYIWIPLEIDEVNNLYFEATRKYKNYDLDNALDMYSKAFNRAQQAAKNAKEAKALKETDERMYKQLKALEAASNLPIYSNNKLIKPSPWNGRAFIKERNSHLNLLNTNKDTYLLGEAEISIPIVLAYEEKVEIAKNSKPQEQFKTLELIERSRTLWEKGVEAKNVKNFRLANELFLESARYLEAYQSNASSELYVIKIGNTLWGISKKLYNDPYLWPKIWFANRQKIQNPDLIHSNWKIIIPAK

SEQ ID NO: 414 - protein, 528 aa, Borrelia burgdorferi sensu stricto
MKLQRSLFLIIFFLTFLCCNNKERKEGVSFKISLGAEPSSLDPQLAEDNVASKMIDTMFRGIVTGDPNTGGNKPGLAKGWDISSDGTVYTFNLREKITWSDGVAITAEGIRKSYLRILNKETGSKYVEMVKSVIKNGQKYFDGQVTDSELGIRAIDEKTLEITLESPKPYFIDMLVHQSFIPVPVHVTEKYGQNWTSPENMVTSGPFKLKERIPNEKYVFEKNNKYYDSNEVELEEITFYTTNDSSTAYKMYENEELDAIFGSIPPDLIKNLKLRSDYYSSAVNAIYFYAFNTHIKPLDNVKIRKALTLAIDRETLTYKVLDNGTTPTRRATPNFSSYSYAKSLELFNPEIAKTLLAEAGYPNGNGFPILKLKYNTNEANKKICEFIQNQWKKNLNIDVELENEEWTTYLNTKANGNYEIARAGWIGDYADPLTFLSIFTQGYTQFSSHNYSNPEYNELIKKSDLELDPIKRQDILRQAEEIIIEKDFPIAPIYIYGNSYLFRNDKWTGWNTNILERFDLSQLKLKNK

SEQ ID NO: 415 - protein, 541 aa, Borrelia burgdorferi sensu stricto
MSFNKTKKIGKKIKIVTLLMLAVSLIACNNNSEKEKLAFKVYIGGAPSSLDPHLVDETIGARILEQIFSGLLTLNTKTGKLKPGLAKNWEASKDKKTYQFYLRDNLFWSDGVEITAEGIRKSFLRILNKETGSTNVDMLKSIIKNGQEYFDGKVSDSELGIKAIDSKTLEITLTAPKPYFLELLLHYAFMPVPIHVIEKYKGNWTSPENMVTSGPFKLKKRLPNEKIIFEKNERYYNAKEVELDELVYITSDNDLTVYNMYKNNEIDAIFNSIPPDIVNEIKLQKDYYQHKSNAIYLYSFNTKIKPLDDARVREALTLAIDRETLTYKVLNDGTVPTREITPDLKNYNYGKKLALFDPEKSKKLLADAGYPNGKGFPMLTLKYNTNETHKKIAAFIQNQWKKILNINLMLTNENWPVLTNSRNTGNFEIIRVGRIGEYLDPHTYFTIFTRENSQLASYGYSNLEFDKLIRESDLEKDPIKRKQLLRKAESIIIEKDFPAAPIYIYSGHYLFRNDKWTGWNPNVSEVYYLSELKPIKNAKHN

SEQ ID NO: 416 - protein, 398 aa, Borrelia burgdorferi sensu stricto
MKENDFIKFGSYLRKVRDSKNLTLEMVAEDIKISIKYLKALEESNIEIFPNEVLAVGFLRTYSEYLDIDSRLISTLFKDYKSRLNNSYIGIKSEDKISNLGFLSDNKVSEKKIFFFSLESLSIFKVFLGIVGVLLLFVFLYFREVEGYFKKFFNLSQDEKIISNIHEVSFDKKNFWNVSLKEGDFLSLTYSDDIAKYRASFIGDDLVIVDESKKSKNILNLGEFKEINLDDNIRVKIIYENYYYDKLKIAHVSLESFALNVKYVSETNIDNRFNILNWQFDVKGTEKLPSSNYLTLYSSQKLSNVDLKIDFLNDTFFRYADENNLYGKSLFASKGIPINLAFEKSLILFFSRLSDVNIILNDRDITPFLKEQGKEIFAVQFFWVKTPSGFDLKVSEVY

SEQ ID NO: 417 - protein, 475 aa, Borrelia burgdorferi sensu stricto
LIKMSLNYTEINTLIKEIPFTNSLITKIIQPDYKSLVLEIYNKIDNKKFKILICLNPNTTRFHITKKNFKKNALKLRFSDFLKSKIQNGKIIKAFQMKNERIISLEILQKDMIILFIKLWPSSPNIIATNSNFKILDAYYRRPKIKETTGEIFLKAKEIHESNKMSDKKIMELKEEYNNTSYTSYSEFLENYYESLNDQIKKTNIKELLIEKYKKELIVLEKRIDSLKQQIKLLENIENEKEKGELILLNINKIQKGIKEINLLNYKEEKIKISLNQSLSPKENALQYFKAYKKGKNSFKTIQNQLKDNLDKFNLIQSKITMLKVENLIPEEEYNQEKTAIKEKEKTPKIGLHFTYCGFEILIGRNAKENDKLLRHCVKGNDYWLHTRDYPGAYVFIKNQKNKTPSLDVLLGAGNLCVFYTKLAKKSGKADLYYTQVKNLRRVKNKKLGLVIPKAEKNLHIKLDENLIKKIKNQT

SEQ ID NO: 418 - protein, 599 aa, Borrelia burgdorferi sensu stricto
MKREIYAFLSNFIIFMCFFLGLLFSYSYFFGENFLEKHKLIATFFDSILLFYKYFFGFFIFIVCIYFAFFVQQEIKIHLKSHNGYLFSRLYAFLLLFFIIGLFFTFIFNLILPYIIAQRNEYKFSYDRYNLLESEANEISLKIKHIDISLAANRFFLSSDLTDSMKQKRKHLENLIRIYDKMRIIYVNNEELLTNYYLVKSEYSKIPSYDVDLEKVKKTFSKYPLQSLKKQDFFNIVNEFISKNDYYTANYFAYIAYVATKDDNFVVLLNLTLKFINENRNFEKEKMQLISEEKQKNFLFLNTEKFKLAYYGFSNLYKLLPSDNEILNYKNKSLEKLRKRYLFFDEIEKYFEYYGINDVFLLQPDSKRGFYDYIYMQKVVAFNNHSKIIKNFELIRFNNTGNVILHIKIPFATLKGNSVYQNILDKDNEQSEITLTKVFVSTDSFDTNVLEVVKINENVENLALFSNFTEFGFFLKIQNLPSAFHRVAILNLKLINTFSLSLVLLISPISLVLIGAFFISLFSKIEFNFNSKAMIFLVSLMIAIFSGITCLFVNYFLIVFTSLLIYVFNSVYVSLAILSALLFFLIFKIITLNYKERLI

SEQ ID NO: 419 - protein, 475 aa, Borrelia burgdorferi sensu stricto
MKNKFLICVYFLLTLGISSLVIVESIFAFDESNNKLSRSNYEQMMIQAFEFVKENYVDPVSDEVIFEGALKGIFQSLGDPYSQYLTKKDLEEISKTTVGDYVGIGISIIKKMHSQDKQDKAKDFDPNSACVSIVTPFEGGPAYKAGIKSGDCITAVDGKSVYSMEVDQVVDLLKGKEGTKVKVSILRGKNLTLDFELTREKIEIQTIKYDVINSDIGYIRIVSFNPHTSVDFRKALDNLKNKNIKSLILDLRLNTGGYFQAAIKMADDILSKGIIVSTKSRNSSKPIDYKASSKQVLPSNIKIVALIDRSSASASEVFVGALKDNKRAYIIGEKSYGKGLIQHVVPFYTGGFKITSSKYYTPSGKSIHKVGIEPDLEIKSPDFSEEEALIYKEIFDKKLIEGFLKGKKFITEQEIDFFVENLVKENPKYKIDKEFLGKYVFFNYYQDNNKELPIYNLHYDKVLKTACEYLSKLGN

SEQ ID NO: 420 - protein, 458 aa, Borrelia burgdorferi sensu stricto
MKKQNPWIYLNEEEKNQILNFSESYKKFISKFKTEREVTAYALDKAKKLGFINAEEKKNLMPGDKIFYTCREKSVAFAIIGKNPIEDGMNFIVSHTDSPRLDAKPSPISEENELTFIKTNYYGGIKKYQWLSTPLSIRGVVFLKNGEKVEINIGDNENDPVFVIPDILPHLDRKIQRNKKSDEIVEGENLKILIGSLPIETKEKNKVKLATLQLIKEKYKIEEEDFVSSEIEIVPAGTAKDVGFDKALIGAYGQDDKICVFTSLESIFDLEETPNKTAICFLVDKEEIGSTGSTGLDSRYLEYFVSDMIFKIKKSEYNNLHVQKALWNSKSISADVCAAINPLFSSVHDEQNAPQLGYGIPIMKYTGHGGKSMASDADAELVSYIRQLLNKNNIAWQVATLGKVEEGGGGTVAKFLAGYGIRTIDMGPAVISMHSPMEITSKFDLYNAYLAYKAFYRE

SEQ ID NO: 421 - protein, 344 aa, Borrelia burgdorferi sensu stricto
VLYMRIVIFIFGILLTSCFSRNGIESSSKKIKISMLVDGVLDDKSFNSSANEALLRLKKDFPENIEEVFSCAISGVYSSYVSDLDNLKRNGSDLIWLVGYMLTDASLLVSSENPKISYGIIDPIYGDDVQIPENLIAVVFRVEQGAFLAGYIAAKKSFSGKIGFIGGMKGNIVDAFRYGYESGAKYANKDIEIISEYSNSFSDVDIGRTIASKMYSKGIDVIHFAAGLAGIGVIETAKNLGDGYYVIGADQDQSYLAPKNFITSVIKNIGDALYLITGEYIKNNNVWEGGKVVQMGLRDGVIGLPNANEFEYIKVLERKIINKEIIVPCNQEEYEIFIKQILKL

SEQ ID NO: 422 - protein, 784 aa, Borrelia burgdorferi sensu stricto
MLDIIKELGFRYATKFGCTISMSDIIVPDEKRTYVERANKEIAKIQNDYAKGVITGEERYNNVVSVWLKTNEELTNKMMEILKKDRDGFNVIYMMADSGARGSRNQIRQLAGMRGLMAKTSGDIIELPIISNFKEGLSVIEFFISTNGARKGLADTALKTADAGYLTRRLVDIAQDVVVRIEDCGTINGIKVETVKNGEEILESLKEKAVGSYSIERIKNPITGEIVLDANEEISEAKIELLEKIGIEKLVIRSVLTCEAEHGVCQKCYGRDFSKNKPVNIGEAVGIIAAQSIGQPGTQLTMRTFHIGGVAQAGSEDDKISLKNAFILNGIEGFNVRVDNGILFTRKGTLKIINVFYEEKIKNIKEIKVLDSQRVIKGIPLFIDKKGSEILSSYIGYVKLRDDNFFIVSEEQEVSLKAGTKLEIEVGDYVESGKVIGTFDPFAEPIIAEVKGKIKFKDIILGTTLKEEINTETGNVEKRITDNVFESLDPRIFIIDSSGMEVASYVLPGDAYLQVEDGQSINIGDIIAKLSKGSEKTQDITGGLPRVNDLFETRIPKNLTEMAKVSGIVQFKSIQKGKRLINILDEYGVEHKHYIPAGKHLLVRDGDVVKAGDMLCDGRINPHDVLEILGGISLQEFLLAEIQDVYRKQGVSINDKHIGVIIKQMMKKVKIVAVGDTNFVYGQKVDKHTFYEQNRKVIEQGGEPAIASPILIGVTKTSLNIDSFISAASFQETTKVLTDASIAGKIDDLRGLKENVVIGHLIPTGTGMGLYKKIKVSENIDSEV

SEQ ID NO: 423 - protein, 1155 aa, Borrelia burgdorferi sensu stricto
MIKRVHLGQGRADEILDLPNLIEIQLNSYEKFLQLDKLKSKKPLLNEGLESVFRNIFPIKSGNGDVALEYERYYIENDALNFTEKECKRKGQSYEAVLKVRLNLQFLTTGEIRQKDVYMGTIPLMTERGTFIINGAERVVVSQIHRSPGVVFYKEKDLYSARIIPYRGSWLEFEIDSKKDYLYVKIDRKKRILITLFLRALGFDTREKIIETFYNIKKIKVEDGTKRDLPGQYLAKSINIRENMYYRAGDKITLQDVEDFLQNGVNEIELVDFDGYNDISGKRFVSSNVILNCLEKEDAFFALKDGSKELPKESVMLAVYGSLFPGEPISIDNAENDLKTIFFSERRYDLGRVGRYKLSKKFGFDDLTTSVLTMDDIVNTISHLLRIYEGHDILDDIDHLGNRRVRSVGELLTNIYKGAMSRVEKIAKDRMSNKEVFNLKPQELISVKPIVSAVKEFFATSQLSQFMDQVNPLAELTHKRRLNALGPGGLSRDRAGFEVRDVHYTHYGRMCPIETPEGPNIGLIVSLATYSRVNDYGFLETPYRKVVNGVVTDQLEYLSAIDEEKKCIAQANAAFNSNGKYLEDLVSVRISGDYTTTSPTNIDYMDVSPRQLISVSSALIPFLEHNDANRALMGSNMQRQAVPLLFPKPPIVGTGMESVVAKDSGVVVKAKRSGEVILATSSKIVVKPFEAENAKDLDEYHIVKYERTNQDTCFNQSVLVKEGQKVERGEIIADGPATRYGELALGNNLLLGVIPWNGFNYEDAILISDRIVKEDLYTSIHIKEFSIEVRETKLGPEKVTGDIPNVSEKILNKLDENGIIRIGTYVKPGDILVGKVTPKSEGDITPEFRLLTSIFGEKAKDVKNNSLKVPHGTEGTVIDVQRITKEDVGNLSPGVEEILKVYVAKKRKLKEGDKMAGRHGNKGVVAKILPVEDMPYLADGTPLDICLNPLGVPSRMNIGQLMESQLGLAGKYLGESYNVPVFESATNEQIQEKLKTAGFNPTSKEILYDGYTGEPFENEVMVGVIYMLKLHHLVDDKMHARSTGPYSLVSQQPLGGKAQFGGQRLGEMEVWALEAYGAAHTLQELLTVKSDDMSGRVKIYENIVKGVPTNVSGIPESFNVLMQELRGLGLDLSIYDDAGNQVPLTEKEEELINKS

SEQ ID NO: 424 - protein, 342 aa, Borrelia burgdorferi sensu stricto
MLIKKICFCLLLLQAKIILSQDQQNLEFNNEYFYFNFQSAYYPPHELGTNGSGFSQSFKHPNFQNIDPSLKIPVNYWGGIKLISYLGYYKNFKALNNPNSIFFKNNGIDIDLNIGLSPVIVSFKSTVSFTPIAFLNLYASNELGIGWQAFGFKGVGVHIENGKYSNAVEFYSEITAGGRFQFDLNAIFQGEWTHIITVIGNDFTYLINPHAKKDQLWKYKADDGKNINGMLIKPYALLAYKMPIPLNTIGLLYEGKTQIGKERNISSWKNKGWGSDIFYHNISIVANFEIIKPLTLGLQFKLSTNPTYTSNTAGLADISKRIATGNSYFYYDSIGMSITYKY

SEQ ID NO: 425 - protein, 1494 aa, Borrelia burgdorferi sensu stricto
MKKANFLSTNFLILLLVCFVNVNLFSKDIFKFKLVDQFFPFYYKNNKGEYEGLIFSILDKWAKDNNADIMVEHIDNLNESEIEDEAIYLGLTYNVKLNDFFYFKSELARSISILFFKNSNKKYKNTHSTFLSNFNIGVIKNTIYEDILRLKNVNTIFLADNSQELVLALKNDKVDYIYGDCKTLHYIANNFLSEDLVIFTGDVFYSIKNRVAISRNAPEIVKNLNLDLFSYLMKMPEELVFSFLDSNAKGSFVDVGLYNDYPPLSFINSQGKLSGILVDLWNLLSRQHIFKPIFKGFSKEDIKKSLDGKSVGIFGGIISNDSVLENVNYVVSKPIYPLNFKFYSKDLSNDAGPINSQFIDFNFNNIQLNKNKDIVNNFIDIVNNSYGFIENSITTKYLLKLNGYNGRLKSYDSIFNKNRFLVLAIDNRIYKVIKYILNSIFDDISFESLLQIDKNWLDKEEINSSRINSYKIMNKVKFNIEEKIWLSKNNKLNLAVKNWYPIDYVEANNYKGINQFLLDKIRMFSGLRFNIIKVHSSLDLKKLIKSGKIDMLNTNATDSNLDNVFNIKLNSRIPLYIFSNKKRVLPSRSLEKFAILDFLYSKNLASNIKSKLILVSSFNEALLLLYKGKVDGIISDEYTAAAVFEELNIDDVEKIPTFRDLAFDLSLAIYNQDYILKEIIQKVVMRSNVDSQMYLNDWKFDIYYKSRSIRFKNFKFLVITFIIFYFTFLGFVIIFMFRLSFEQKRRYSFVMNEKKIAEAANAAKTIFIANVSHDIRTPINGIMAATELLDTTILTDVQKDYVRMINYSSDSLLSLIDDILYLSKIDVNELYVESQEIDLESEMEMVLKAFQSQCAKKNIDLFSYSKSIFNNYIKGDIVKIKQVLINLIGNAFKFTDDGVIVLNYEEVCRTRTDGNRVLVTVEFKVIDTGKGIEKENFSKIFEIFKQEDDSSSRVHEGAGLGLSISRELIRLMGGLGIAVDSKVGEGTTFSFMLPFLLGSELKSKKLSINRFQSVNGDNKVLNVLLSQKSIKIFEHCSILLGCSSNVRYVASFEDAYKVFKKYPSYNFVYINVNNDNIQEGIRLANNIERLNSDVQIIFLFYYLDNKALKNLKYGYVKKPLMGLGICSILYKKEFNPEMDFEDLVPIDSALRIKEPINVLIAEDNQVNQKVLKDILVVIGINENFIDVVDDGVKALKSLKDKKYTISFIDIRMPRYDGFSVAKEIRKFEKAKNLKPCVLVAVTAHALQEYKDKCLASGMNDYISKPIHISSIKTILKKYLQFEVDDIGENENLNQLVKFPNLDVNRALKELNLSYVSYSELCRGLVDFISINIIDLEKAFDEEDLSLIKDISHSISGALSNMRSELYKDFQKIETSKDSISELKKMYSFVKDDLFQLISDIKENILFESEIVSENKLYFKNNDQFLNLLNKLLIGIKTRKPREYKEILESINKYVLDDNIQVLFSDLRRNLRLYRFAESSKILEEIIEMLNNKRY

SEQ ID NO: 426 - protein, 260 aa, Borrelia burgdorferi sensu stricto
MDGVYKMIDIQLLDIDNDQPRKFVSPVELEELSISIKENGILQPIIVCKANERYKIIVGERRFRAAKLIQMTNIPVIEVNIKESCRDFMPLVENIQRENFTPVEEAYAYKNVMNKYSLTQKDLSEKIGKSRAYISNLVRILDLEQEILNAVHRKEISFGHAKVILSLKDKQDRYNLYLMIVKKKFSVRDAEKYVKNFYKSIVRKRELEQDPFLSNIKEFLFDKIQTKIDIKGNQDKGKIEIEYFTAGDLRRIVSFFGNIS

SEQ ID NO: 427 - protein, 639 aa, Borrelia burgdorferi sensu stricto
MNGRFMNYVASNIQVLKGLEAVRKRPGMYIGSVSINGLHHLVYEVVDNSIDEALAGFCDRIDVIINLDNTITVIDNGRGIPTDIHEEEGISALELVLTKLHSGGKFNKGTYKVSGGLHGVGISVVNALSSFLEVYVNRDGKIFRQTFSKGIPTSKVEVVGESSVTGTKVTFLADSEIFETLDYNFDVLEKRLKELAFLNDKIYISIEDKRIGKEKSSKFYFEGGIKSFVDYLTNDSKAFQSEPYYIDGFINDVIVNVGLKWTESYSDNILSFVNNINTREGGTHVMGFRSGLTKAMNEAFKNSKISKKDIPNLTGDDFKEGLTAVISVKVPEPQFEGQTKSKLGNSEIRKIVEVVVYEHLLEIINLNPLEIDTILGKAIKAARAREAARKARESERKKNAFESLALPGKLADCTSKNPLEREIYIVEGDSAGGSAKMGRNRFFQAILPLWGKMLNVEKTREDKVITNDKLIPIIASLGAGVGKTFDITKLRYHKIIIMADADVDGSHIRTLLLAFFFRYMRDLIENGYIYIAMPPLYKIKYDNRIYYFYEEKEKEKFLDSIETKNRNSISLQRYKGLGEMNPTQLWETTMDPARRKMRLMNIDDAIEAEKIFVTLMGDLVEPRKEFIEQNALNVINLDV

SEQ ID NO: 428 - protein, 506 aa, Borrelia burgdorferi sensu stricto
MINANMKTGHFEILAKNIEIISKCNELPFMIEDDNNASENSKLEYRYLDLRRDSLKNKIILRCQATHLIRNFLIKRKFLELETPTFVKSTPEGARDFVIPSRIHKGSFYALPQSPQLYKQLIMIAGFDKYFQIARCYRDEDSRGDRQPEFTQLDLEMSFVKKENIFKLIENMLFLIFKNCININLPKKFKKITYKKAMNKYGSDKPDTRFELELQDISRNLKNSEFNIFKDTLKNKGSIKILIVKDKADKFSRAKINNLEEIAKLYKTQGLYFTKIENNKFSGGIAKFLKTEEQELIKTYSLENNDIIFFTANNNWETACKAMGQIRIKIANDLGLIDENKFEFLWVYDFPLFEYDENTKTYSPAHHMFSLPKKQYIANLEKNPKKTIGEIYDLVLNGVELGSGSIRIHNKELQQRIFKIIGFQKEKSEDRFGFFLKALEYGAPNHGGIAIGIDRLIMLMTKSTSIKDVILFPKNSFAASPLDNSPSKISNEQLKELGINIVDGDN

SEQ ID NO: 429 - protein, 229 aa, Borrelia burgdorferi sensu stricto
MKTIEHELYYEFRIADDVKMIYTKKPFNLKLKELSNDNFNFVPRSKKIKYLKQLHTDIIYKVEDDFINFQEGDGLISSSLDVALVAYFADCLPIYFYDSVKKIIGLIHSGYKGSFNLIILKMLFMFEKMGSALKDLKIVFGPYNRSCCYEVSEIFLKEVSNKFSKDLLNASFVTRDGKIYFDNASFNLNLLSSFNLNIYNSKLCTYCLKNLYSYRRLRESQSYALIWRI

SEQ ID NO: 430 - protein, 442 aa, Borrelia burgdorferi sensu stricto
VRFNFIKFLYIGGWIMHSYIVEGGYKIGGQITASGNKNAALPCILAALLTDEEVILENIPNINDVKVVLDILNDIGADIAREGNTLKIKVLNIVKTEIDSSFTDLIRASILLLGPFVSRFGKIDMALPGGDVIGKRRLDTHFYGLCKLGAKLSTKDRRIVLKANKLVGAEMFLDEASVTATENIIMAAVLAEGNTVIMNAACEPHVQDLCNMLNSMGANILGIGSNVLEIKGVKKLSGTVFRIGADFMQVGSLISLAALTGGELEIKKADPQHFRLIRHVYSRLGINFEYDRENVYVRNKQELKVKLDFGGHIPKIDDGPWPAFPTDLMSIIVVTATQVEGTVLVFEKMFESRMFFVDKLIKMGARIVLCDPHRVVVTGKSSLKGNVLSSPDVRAGMSLLIAAFVAEGRSEIQNVYQIERGYEDVVNKLINLGAKIKKVKSQ

SEQ ID NO: 431 - protein, 209 aa, Borrelia burgdorferi sensu stricto
MERKVFSKDGKEIGTINLDDRVFNIEISHGSIYNAIKNELSNLRVGTSSTKTRSEVRGSSKKPWKQKGTGRARVGTKRNPVWIGGGIALGPKPRDYSYRLPKKVKKLAFKSVLSLRAADENSFKVIENFNVESGKTKDLALIIKNFASFNGKVVILLGNDDQMIKRAGKNIRDLKILSFDKLRVVDLFYAKNLIALESAVNKLNEFYIK

SEQ ID NO: 432 - protein, 2166 aa, Borrelia burgdorferi sensu stricto
MIDFATILVNLFLVSIVLFVYRQYDKRSRALDKIKKFVDLTKVNLEDFIEDKTKEINDLAVDMEAYQRSSIEIIKKIEEVQQKIKNKSNDFAEVEKKIAYHDSMLKDLDEMTFKVQENIQRLQVDGKIVDKLSKTLKGFNTQIDSVESNLNSVLEKFDKANKENLESIKIASWEKFDTNIKELVFKIDNLNKEISLYEKDLANIEERKNDILVKGNEKLDLEFSDFLEKVEFNIGKYSKEIESSFNFYENKYKLIENSIELIMESVKNKINEKEDFILNRLNEELQNKFKDILVYVDDRSKEIKDKLEDKLVLVDNEISSMSSSFKDNVYSRINSLEESMRIEMGKYEEQVDDVFDKFRSQVELNLKNIYEDYEDKISQVDNNIRERVELSLLDLNSKMESVQSGAIDFIKRLEDDSNGIYLEFKGKFGADIEVFSESFKGDINQLKMQLESQLLDVDSNIQEKLIKLNDNLISNFEEINGRFNNNYSNLNDNINAKYTALFESLDSSSSKFENQMESKYKSFTDKLTAGMDEFSLMYGEKFETLSQEATNNYQEFQDLNKKLENEIESFYNMFEKTQETLKVDFNTSLINIKDEIGKNIVEFRDRYYDEVNIFVTQLEESKLQYSKWQGEMDSNLKNIESQINKTNEEFLSLIQIQKDKGIELSESVFNDLSDHIQKKAIDMHGSWKDELIALNKSLLDIKVSSEELLSSATLKIESLEKDVNDRMEYVLLKTGDIESLVIEKYKELKDMSYSQSDEAILGIKEFINRQTEIIKDKSVFMLEDLNKKFDDKNNFVISKIEECDYKLKDFKIESEDILNNFKSDLNEFIESKLQIVSNIKSDNQKQIDDFLDRISKDILNRKDSINNEVDSKLSDWQSKLNEITVKIENLLSSGKVDLDLIDSEVTTKIKELKFSIESLESYYLEKIDEFRNQGAIYSDELLQDIMNHFNKETRELEENLSKKFAAVLNNSEEFVKEVDSLLQDKRTDIASFQANIDITLDSLNVKFNDINKEINGKYNEVISNYRGYSENISSKLENEIMHEIENLSRRLTDRIDSLSKGMDENLQKLKESFDVSKYQVEKFELKVKDLTDDGEAKINKLVKEIEQYYKSRLEEAIDYRRTIDNDIMQAKERFGEITNELKNNIESKSEFLNDLYKERFKLIESNFEERYSTFLIESEGAISKIRDEIYKTLTSNDENLQIKISEMDQNFEIIEQRSKDILEFEKELQDKIKDCYGFINSQFGEIKAGVEENIKNHFDVCIKKVNTLIDDDIVKYENEIHKRIDSLKSIESTFDSIEKNLNDKVSGCIDKIANDFNLKYIELEERCNEGQLNLENKIDNKIKAIDNLALSQYDGLEKKYADMYDEFSERLNSYIATLSEEFKSSNKEMIFELESQLKNLKNLESDLNNVEKDVIRLKEESYHNVSSHLKLLEEDFFKDLKIRGEELKYSLENFIASYNDKIQNLEYDLSKNLENKTELIQSFRLDIEQKMKDDKENFYLDFTKEFSSKKKDMQSEIALMETNITGKVDEFVDFVNNKQSIIDSWFLNIKDDVKDWQEKSYSTIEKRINLAELGIKSFENDIFNVKIGLESFKDGFEIKAEEIFSNLQNEAKKIEQSVHLDFKNIGESLNLKVLDLEKFVDFKLEKIDEKVNKKTEDILIQAEVKFLTQQKDLEDKIFELNQKLEHEFTTLSSNLDKVRREMVDVISSDKESFEGQIELINKNISEFSEKISLYRNNIETSIENEYNSFSKSIKSDLGLLEDELKKSLKHSTSEIETIKSGLQEQIDKFEVEFKKNHKELLKEVDNNILELESKILNCDVQFNKFISEIKDNLVEYKSDLRAEFEDSYDKINFQIENQIENFKKLDSELEKNNSIFLEAYSLKDKLEKLWETLKNEIGLAQEYKNNFENVNKEFYNIQKETLGIIEIFNELKLEQESIKSIKNDFNRFFEFYSSFDSRYKSLIESYDEMQIYKAKIKEIADEQRTILDNYERISNKESILKSTIESVDKNFDLINEVEKRFNNLSKESAKIQDNLKDMENVVSSLLLNKGLSEEVLINAQNLKEMLLDIENKLKNTLTMRERVVKSETRLENLNIAAEERIKTLGILVKTDSKYQDNVGLNNETVRNSVIKLMRQGWSAEEISRATKLSIGEVELILELGISNKGD

SEQ ID NO: 433 - protein, 635 aa, Borrelia burgdorferi sensu stricto
MGKIIGIDLGTTNSCVAIMEHGKPVVIQNSEGGRTTPSIVAYTNKGERLVGQVAKNQMVTNPENTIYSIKRFMGRRFEEVASEIKMVPYKIEKGLNGDARVNISNIKKQMSPPEISAATLTKMKETAEAYLGEKVTEAVITVPAYFNDAQRQATKDAGKIAGLEVKRIVNEPTAAALAYGIEKKHEEIVAVYDLGGGTFDISILELGDGVFEVKSTNGDTHLGGDNFDDEIIKHLISEFKKESAIDLSNDKMALQRLKEAAEKAKIELSGAQEASINLPFITADANGPKHLQYTLTRAKFEQMVDHLVQKTKEPCLKAIKDAGLKASDINEVILVGGSTRIPAIQKIVKDIFGQDPNKGVNPDEAVAIGAAIQGGILTGETKDMVLLDVTPLSLGIETLGGVMTKLIERNTTIPTKKSQVFSTAADNQTSVDIKVLQGEREMAAQNRILGNFILDGIPAAPRGVPQIEVSFDIDANGIVHVSAKDMGTGKEQKIRIESSSGLSESEIDRMVKDAEAHAEEDKKLKENIEAKNTANSLIYQTEKSLKEYSEKISSEDKEAIESKIKELKESLEKEDISLIKSRTEELQKASYKIAEMMYKDSSQQNANSQQENGPQSNTSEEGKEADYEVVDEDKK

SEQ ID NO: 434 - protein, 187 aa, Borrelia burgdorferi sensu stricto
MEKKETKSESEKTNKQDNKNTKSQKKENLNLVNSDKKIAELENEISNLKDLYLRKQAEFENFRKRLEKEKDNFVKFANETIMKDVVNFLDNLERAINSSKKSKDFDNLLTGISMIENEILSIFDKKYNLKKFGENGENFDPSRHEAISIEEKEGLKNPEIVEVYQKGYCYNDRILRTAKVKVAQSKN

SEQ ID NO: 435 - protein, 286 aa, Borrelia burgdorferi sensu stricto
MKDLNENNDNNKGFFVALTSIATVCIIIFLGTIIFFPNKNLASDIAEKNIVLEEDKDPNTLEKVDQNEKSLKVSETQNEIIIDLTQDLNKEKKPTNKIPNTQKSKIIEKPQPTTQKISNTSQKSKTIEKPQPTTQKISNTSQKSKTIEKPQPTTQKISNTSQKSKTIEKPQPTTQKISNTSQKSKTIEKPQPIAQKTLNTDNIYDPNIEYYIQFVSLSDPINADNYIQKLLKYNIIARIYSATVDNKDIYRVRSGPYKTKSEAKADFKKIAGIGEFKETYILPVNK

SEQ ID NO: 436 - protein, 497 aa, Borrelia burgdorferi sensu stricto
  misc_feature (198)..(198): Xaa can be any naturally occurring amino acid
MNKTKNRSLTYFIILSCISLFGANNNTISYSSIEIPLEDLSEEFKSSGNKSDQINTSKHLNKNIVSYEDPKKGKDLKLPENIRDKKLPQKRMDENDLKSVIENYENKIKNIEKLLKTKNQKTSENENKKIESIEKKAKKYEILTNKLKNEIVEIKKLLNKKIKPKEDENYEKINIENIEEETDDDFEDNYEYNDEIEXTNEDNYPSNEGIINNLKENLNENEKYYAINEKKIDELEDRINENENTILDLQRELRNFKKKDNSDKNLEEIEENLSSIGRIINDLKRKISANEAINKENQKKIRTDKHKLKELEDKIKENEETILKLQKELNNFKKKEIYQKPLNEETFTPSITSKNDDLEENKKLKKEYLKPIEKKESRDLEENTKSTPKTTMIKTADFQIYPDIYLNNYKFKEKGDQFAFKKENTYYIEIDPTNNLNEALKNHEIISKYKFEKYFINPILKNKEEFFRNLIEVKNIHELGIMYKNLKPEFKQIKIIK

SEQ ID NO: 437 - protein, 650 aa, Borrelia burgdorferi sensu stricto
LILIFYFKQIALFIIFRLCYIIKKVKIKLKRKSCMKKQFDTEVNDLLYLIIHSLYSHKEIFLRELISNASDAIDKLKFLSLTNEKFKNIALEPKIEISFDDKSILIKDNGIGMDEQDLTNHLGVIAKSGTKEFINNLKQDEKKSASLIGQFGVGFYSAFIVSEKVEVTSKKALESDAYIWSSDGKTGYEIEKAKKEESGTEIKLYLNKEGLEYANKWKIQEIIKKYSNHINYPIYIKYSEPIMKDGKQEGIEEKEEKLNETTALWTKNKSEIKAEEYNEFYKNTTFDYENPLMHIHTKAEGNLEYTNLFYVPSKAPYDLYYPNTKPGVKLFINRIFITDSEGSLLPNYLRFIKGIIDCQDLPLNVSREILQQNKILSKIKSSSVKKILSELEKLSKKNPEKFSEFSKEFGRCIKEGVYSDFENREKLISLIRFKSSSVDGFVSFKEYKERMNESQKSIYYITGGKENILKENPIVAAYKEKGFEILIMDDELDEAILNLIPEYEGLKLKAINKNETSNELKDENFKKIEEEFKDTLTKVKEILKDHIKEVNLSATLIKEPSAIIIDSNDPTYQMQKIMLSMGQEVKEIKPILELNPNNKIVQNLKNLEPEKLEKISILLFEEAMLTSGMPSKNPGKFINIINEFIEKDFL

SEQ ID NO: 438 - protein, 229 aa, Borrelia burgdorferi sensu stricto
MLEIISLGGGVINSNQINIEFIKNFKNFVFKWLLENEKRKIILIVGGGRVAREYQDAYKKINPDFKVHELDEIGIISTRLNAEFLSKVMNPFCKDKIVTNPLKNFSFKGKILIASGWKSGFSTDYIAVKFAEKFNKKDIINITNVNQVYDKDPKKFKNATAFKKLNWKQLQNIVGQKWNPGLNLPFDPIATKLSSKLGLTLYIVNGNNIENLEKVFNKNNDFFGTIIVK

SEQ ID NO: 439 - protein, 1161 aa, Borrelia burgdorferi sensu stricto
LLKIKFYFDKIILGMSFRSRFIHLHVHSDYSLLDGAAKISDIISKAKKCNMSHIALTDHGNLFGAIKFYKEAKKAGIKPIIGIEAYMAKTSKFLKKQDDLGKMSYHLILLAKNELGYKNLLKLTSISYLEGFYYRPRIDKDDLEKYSEGLICTSACIGGLIPRLILANRFEDAKNEILWFKKVFGNDFYLELQRHGIKDQDIVNERLVKYSRELGVPLTAANDSHYVNREDATAQDIIVCIGTGAKKSDENRLKMETNEFYIKSQEEMCELFNDLPEALENTVRIAEKCDDFKITFPGPILPDYQIPVEFNTLGEYLEHLTLEGLKFRYKNLTSKIKDRAFYELSVIIGMGFEGYFLIVWDFIKFAHDNDIPVGAGRGSGAGSIVAYALRITDIDPLKYNLLFERFLNPERISMPDFDIDFCFEGRDEIIKYVTNKYGEDKVAQIITFGTLKPKAVVKDVARVLDIPFAESNELTKFIPDGPKVSLKEVLDDNSLKECFTSKPVYKELMNAALVLEGMNRHASTHAAGIVISKTPLTDYVPLYKDYKQGSVSTQYTMDLLEECGLVKMDFLGLKTLTLIKNAENLIRSVNPDFKIKNIPDNDVKTFNMLGEGRSASVFQFESEGMQQILKDAKPDSIEDLIALNALYRPGPMQFIPQFIAAKKGVKRIKYPHPDLKEVLRPTYGVIVYQEQVMEVAKIIGGFSLGKADILRRAMGKKKEDEMNEMKVDFLRGAIEKGYDKEIASEIFELLKPFSGYGFNKSHAAAYSLIAYQTAYLKANYPEYFMAANLTNEINNNDKLSYYIEESKAIGINVLKPDINRSFREFRVTDSGISYGLNGIKNLGGIVVDLIIDEREKNGKYSSFEDFIRRVDDKVINKKFLESAIKSGLFDSLDQNRKTLFENLDHLIEVVSEDKNNKKLGQNSLFGALESQDPIQQSFNYQTFKEYSYSELLGFEKELLGFYVSGHPLDPYKKAIDSFSSLNVLTDLAAKKDSIVQFSGILNSVKVIQTKRNNAKMAFGVIEDFKGAIDIVVFTESYERYRNFLLEGNVIGVVGRLTFNRDKFSIVVEKVVNIERLSEYKINNIHIKFLNNKLNDLQLLNSLKESISNFEDNSGFSNVYFYLRENGKDLKLKMNSILNFVPDEDKLDKLRKCVIVEDVWVD

SEQ ID NO: 440 - protein, 265 aa, Borrelia burgdorferi sensu stricto
MNNCLIKFFIFLLVFSNSYVAFSKNVNVLIVTAMDSEFDQINKLMSNKEEIVLKEYGLNKKILKGKLSNRNVMVIICGVGKVNAGVWTSYILSKYNISHVINSGVAGGVVSAKYKDIKVGDVVVSSEVAYHDVDLTKFGYKVGQLTGGLPQKFNANKNLIKNAIEAIKSKVGGSNAYSGLIVSGDQFIDPTYINKIIGNFKDVIAVEMEGAAIGHVSHMFNIPFIVIRSISDIVNKEGNEVEYSKFSKIAAFNSAKVVQEILRKL

SEQ ID NO: 441 - protein, 618 aa, Borrelia burgdorferi sensu stricto
MKSHILYKLIIFLTTSAAIFAADALKEKDIFKINPWMPTFGFENTSEFRLDMDELVPGFENKSKITIKLKPFEANPELGKDDPFSAYIKVEDLALKAEGKKGDQFKIDVGDITAQINMYDFFIKISTMTDFDFNKESLFSFAPMTGFKSTYYGFPSNDRAVRGTILARGTSKNIGTIQLGYKLPKLDLTFAIGGTGTGNRNQENDKDTPYNKTYQGILYGIQATWKPIKNLLDQNEDTKSVIAETPFELNFGLSGAYGNETFNNSSITYSLKDKSVVGNDLLSPTLSNSAILASFGAKYKLGLTKINDKNTYLILQMGTDFGIDPFASDFSIFGHISKAANFKKETPSDPNKKAEIFDPNGNALNFSKNTELGIAFSTGASIGFAWNKDTGEKESWAIKGSDSYSTRLFGEQDKKSGVALGISYGQNLYRSKDTEKRLKTISENAFQSLNVEISSYEDNKKGIINGLGWITSIGLYDILRQKSVENYPTTISSTTENNQTEQSSTSTKTTTPNLTFEDAMKLGLALYLDYAIPIASISTEAYVVPYIGAYILGPSNKLSSDATKIYLKTGLSLEKLIRFTTISLGWDSNNIIELANKNTNNAAIGSAFLQFKIAYSGS

SEQ ID NO: 442 - protein, 476 aa, Borrelia burgdorferi sensu stricto
MSIVIDSFKEISKIPRCSKNIKGIINFIKQRAKKFGYSFKEDRVGNIVVQIKSNNNIDMHPIILQSHVDMVCEKNESSLHNFETDPIEIVEEDGYLKAVGTTLGADNGIGVAMMLGIMSEANNFPHPDLELLFTVDEEIGLIGALGLDSNLCSGKSLINLDGEEEGYFLVGCAGSRLVEIVFSPKYSLVTKKTKVEILFKGLKGGHSGADIHLDLANSLKLMFFALFEIKANLNFEIEGIFGGNSSNAIPIEAKALIFIDDNDYDLLNKELKLFVLKVKSAYSLEDEFDIIVNKREFSSVKVLDENSKNKLLNMGMGFLHGVQKVENYENKLIKTSLNFSSLLRMQDDYIFTFLIRSLLDLDKEYVCNHLQSISDLSGANLRVIYDDPSWQPDKNSNLLKHLQEVYKEMYLEDANVSTIHAGLETGIISSRLGGIESVTLGPWIEWPHTTRERVNISSTIRVYDFLKKSLERFQKF

SEQ ID NO: 443 - protein, 430 aa, Borrelia burgdorferi sensu stricto
MARVKGQKVKECSFCGLSVAELGGNVVISNGVAICPECSKICHNLFKEKLCKPLDSKSNGLPTPKQLKDHLDMYVVGQEDAKKVLSVAVYNHYKRILKNNKYDNGIEIEKSNILLVGPTGSGKTLLAKTLAAEMNVPFAIADATTLTEAGYVGEDVENILLKLIHAAHGDVSLAEKGIIYIDEIDKIAKKNENVSITRDVSGEGVQQALLKIIEGTVANVPPRGGRKHPYEDTIEINTQNILFICGGAFVGLENIVKNRINKSSIGFSAIEKKNIREDTSLKYLEMEDLIKFGLIPEFVGRLPVHSYLEKLNKEDLLRILVDPQNSIVKQYYHMFKMDNVELVFEKDALESIVDEAILKNTGARGLRSILEGLLKDVMFEVPSISKAKKVVVTKESVLNADVNPLILVGNAIKKPWAKELYEINLKYDKK

SEQ ID NO: 444 - protein, 813 aa, Borrelia burgdorferi sensu stricto
MQLKNLGQKSYMKSILNMIKNRKEDLPIVILKENVLFPNITLWVTFDNEYVINSIAQSMLEERLILFAYSNEPNCDESDRGVVKNLCSVGTYSKLIQVIKISKDVIKVLVECQSRVLIDSVSKKNDYLRAKVTFVPDSSGLNRELFTYSKFLKETYEAYRNSLSLKSYDADNEPINYFENPSKLVDIIASNSNLENSIKLELLQELNVKTRIEKLIVNLSIEIDLLDLKKDINSKVRAKLDKGQRDYFLSEQVKEIQKRLGKDENDYIDRLNSKDIPEDVKSKIEKEISRLSKMQMNSPDANIIRSYIELILDLPWNENTVMKNHLSEIEFILRNSHYGMDEAKEKIINFLAVYQINSKVKAPILCLVGPPGIGKTSLVESIARSLSREFVKISLGGLRDEAEIRGHRRTYVGSLPGVFISAMKRSGKSNPVILLDEIDKINSSYKGNPESALLEVLDPEQNYKFIDHYLEIPYDLSNVLFVTTANSLNGMSKPLLDRMEIIKVEGYSYIEKLEIAKIFLIPSIIKESFLDKVYIRIEDDVIFNLIRNYTMESGVRGLKRVLTNLIRRLVRELLYEYSKDQIIKGNFYSPSSLIHGNNSLFTHDPDIPGIYKIININNYYNYVDTEDNLDLIKIDSSGFVYGLAWTNYGGTVLPVEATKFEKKGDIILTGSLGAIMKESAQLAYSIVKTYSSKLNFDVKESPEIHLHFPEGATPKDGPSAGITIATAIASILSDKKVPLDLAMTGEVTLKGFVLPVGGIKEKVLAAYRNGISKVILPKDNKKDYSKLPEEVKDNIDVKFVSSLEEVFDYLNII

SEQ ID NO: 445 - protein, 697 aa, Borrelia burgdorferi sensu stricto
MITLFKILALRKSKTFCILQIIDLIILFYFLIIGPVNLNADFEYKVVKGDTLFSIAIKYKVKVSDLKRINKLNVDNIKAGQILIIPSDSNLGQNITHKVNHSFSLLESSKGGVFYTAKEGDTIESISKLVGLSQEEIIAWNDLRSKDLKVGMKLVLTEPDFLKPYMVRKGDSLSKLSQDFDISSKDILKFNFLNDDKLKIGQQLFLKKATKNVNFHYVKRGETLGRIAYIYGVTAKDLVALNGNRAINLKAGSLLNVLKIVNNDLEKPVERDLKIEKKIDNKFIYHSVAVGETLYSIARHYGVLIEDLKNWNNLSSNNIMHDQKLKIFDKKLSIDSSIIKTKNDLYIKKKVDSGSNSSNKVQTIVNLPSSKNKKLNLNTFGITANQDLFDISSLVILDSKIPIFEVVGDFYYWYRPRKISQPSEFYSEDWHSPLNSYKKATQLFKSFEKLVNSRFNKGSRLKDKLIILDPGHGGLDPGAIVKSRDGLGNEVFVVEDEYVYDIALRLYVYLKEEGANVEFTILAPDHLIRNSVFANNTFVNVKNEVYNDYDLNKNDTVDSWISGTPSGLKKRLVVVKNIVNKYKHIKDKDIAFFSLHADNSVGAPKSMGFYYQKDDDKKYDIHSKSAAEKITEGMKRSFYIKGQNLHVLRNNIVMTKLLVEVRNLAFPEEAWAIRSSKLRDQDSKILANGILKILENN

SEQ ID NO: 446 - protein, 562 aa, Borrelia burgdorferi sensu stricto
MFRKLKKLKTYIIIISITKFSEDNLLLIISNIKYLIEHKQLAYKIHWTFPIYFFEILREHEELNKWLFERFKTNTDIYMPGTYSGSPHEYMLHDEIHLDLYWALKNPFKSGYKDIFQNTPIMFYIYNIEKFRKKVTELYRKLNFNYTEGIRQSKNNKNYLIFYKNNCQYLYEVQKIDSPKSNVETLIYFYEIKETYDNQELKNFLLYLKALENNLHSIKIQNLEGSKLTTELLEIPKFNSLKEQEPIINFQNKRLKDYQINEKSLREFLINKHQDEIIKNSESIVPKNLEYNMEGNFTLSHDQYNIKFENGKLNKIKFKDKKVEFLNTSRTYFKVSSKKELIKEASIESSFSFSNEKILGIKQYLAFNSAKKSTIDFFIDETISSFFISIKIKWPSKIDLDKKTLKKCNPDYLLEYSALEIPVFEITKGTNLKITAKYSDLDTYEKIIITKNNPKGYINGTEFLISKGNDKNSNFFISFLNVEKHIIHTINYKIEKINSKKWLILNIGGSYNTVKIQDVINYSQTLNLMILPLNNNFDNKIKLNSKIKNLIFYTNIKKYENK

SEQ ID NO: 447 - protein, 545 aa, Borrelia burgdorferi sensu stricto
MAKDIYFNEDARKSLLSGVEKLSNAVKVTLGPKGRNVLIDKKFGSPTVTKDGVSVAREIELENPFENMGAQLLKEVAIKTNDVAGDGTTTATVLAYAIAREGLKNVSSGINPIGIKKGIDHAVNLAAEKIRQSAKKITTKEEIAQVASISANNDSYIGEKIAEAMDKVGKDGVITVEESKTFDTTISYVEGMQFDRGYLSPYFSTNKENMSVNFDDAFILIYEKKISSIKELLPVLEKVLGTNKPLLIIAEDIEGDALAALVLNSVRGALKVCAIKSPGFGDRRKAMLEDIAVLTGGVLISEELGLTLETVEIEQLGQAKTIKVDKDNTTIINTGNKEQIKERSELIKKQIEDSTSEYDKEKLQERLAKLVGGVAVINVGAVTEVELKEKKHRVEDALSATRAAVEEGVVPGGGSTLIEVAMYLDTIDTSKLSYEEKQGFEIVKRSLEEPMRQIISNAGFEGSIYIHQIKTEKKGLGFDASSFKWVNMIESGIIDPAKVTRSALQNAASIAGLLLTTECAITDIKEEKNTSGGGGYPMDPGMGMM

SEQ ID NO: 448 - protein, 253 aa, Borrelia burgdorferi sensu stricto
MLGDFMYKLVLVRHGESEWNKENLFTGWTDVKLSDKGIDEAVEAGLLLKQEGYSFDIAFSSLLSRANDTLNIILRELGQSYISVKKTWRLNERHYGALQGLNKSETAAKYGEDKVLIWRRSYDVPPMSLDESDDRHPIKDPRYKHIPKRELPSTECLKDTVARVIPYWTDEIAKEVLEGKKVIVAAHGNSLRALVKYFDNLSEEDVLKLNIPTGIPLVYELDKDLNPIKHYYLGDESKIKKAMESVASQGKLK

SEQ ID NO: 449 - protein, 341 aa, Borrelia burgdorferi sensu stricto
MKRKAKSILFFLLSTVLFAQETDGLAEGSKRAEPGELVLDFAELARDPSSTRLDLTNYVDYVYSGASGIVKPEDMVVDLGINNWSVLLTPSARLQAYVKNSVVAPAVVKSESKRYAGDTILGVRVLFPSYSQSSAMIMPPFKIPFYSGESGNQFLGKGLIDNIKTMKEIKVSVYSLGYEIDLEVLFEDMNGMEYAYSMGTLKFKGWADLIWSNPNYIPNISSRIIKDDVPNYPLASSKMRFKAFRVSKSHSSKEQNFIFYVKDLRVLYDKLSVSIDSDIDSESVFKVYETSGTESLRKLKAHETFKRVLKLREKISMPEGSFQNFVEKIESEKPEESSPKN

SEQ ID NO: 450 - protein, 466 aa, Borrelia burgdorferi sensu stricto
VQIKEIYFGPKILDDKNSNSKLTNFDFKVVSFELGSDHYLVDIMQVKEIRKSSNFTYVPNAKKYVAGLDNLRGEIIPIIDLRIMFNLEFNKKDIEDIMVLKNEDLLIGVIVDKINNVFSIDSSLIQDPHPVLSQDSLINYIKGVVDYNEKLYILLNVFKIFNYGEEEKLLKPGQNFVEKSDFVSDCDNLDILENSKNDFSNKVSSKNDGNNENSTLNNTAAFNLENIKKNLLKYSFNASLVNDVFLEKVGVKFNMVDTDYLPCDSFLNEFYSKSSGNLWGADCLEEFKNEIVESRLSFMNNLNSIFNVLEIGCGSGKETMALANALSEYYVKPFKLTAIDNDLSKVVETSRLVFSESEIGISEIYSRNSFEQSPGVYKFKSEILSNVLFEYSDALFSDLPDNLGMVFLKDVLCFLDSKDQILILNIIASKAIKGALLVLGDNEELKNNDVFIKEKSTKYFNLYRKV

SEQ ID NO: 451 - protein, 753 aa, Borrelia burgdorferi sensu stricto
MLLKLKYRFVGFLLLFLIFILLLFSTIFNFVLCGYLEDYYKQLTRAQVRRAAFSLQSFLDTLHVIINGAASNLALETISEFAMSENRGKDFSESELIDLRKNPKFVIDSVKVSKKYRQYLYNFMANLKNDTLFEEFAFFDFEGRVIVSTRHENNMDFGHSEANTNYFKKAVEDYRQNQLKFIGWYSNLSEGISAEVAIRSKQSEKKAFAIIVPVYSPEDKLVCGYLAGYLLNDIVADSFDRFRFGFYKRGNFIYVDPNNIAVNPFEEYNETSRVSSKFLNVLKDVFSKPPFPSNIASEVSVYTIDRILLSEMGEDCYYAMLPISSKLGEKSGVLIARLPYKDIYGVISSLRFQYILYSVLGIIALSIVLSIRIDRIISFRLNAIRVLVQDMVKGNLDKDYALDDDENTLDELGMLSLQVVKMKKAISVAISSVLRNISYVNKASLEVASSSQNLSSSALQQASALEEMSANVEQIASGVNMSANNSYETEQIALKTNENSQIGGRAVEESVIAMQDIVEKVSVIEEIARKTNLLALNAAIEAARAGDEGKGFAVVASEIRKLADLSKISALEIGELVEDNSKVATEAGVIFKEMLPEIEETANLVKKISEGSSKQSDQIAQFKMALDQVGEVVQSSASSSEQLSSMSDKMLEKSKELRKSVLFFKIKDSKIENPENDDYDFRLIDCPENSFKDENQNLKSNGISTSNASGHNNYSLDIESESSVRTINKRVDPKKAIDIADKDLNFDDDFSEF

SEQ ID NO: 452 - protein, 317 aa, Borrelia burgdorferi sensu stricto
MDLISFSVPGNLLLMGEYTILEEKGLGLAIAINKRAFFSFKKSDSWRFFSKKKKIDDFSLIENRSDFVFKMFAYLSQNCFFNLENFAYDVYIDTSNFFFNDGTKKGFGSSAVVAIGIVCGLFLIHNATNVVEKGEIFKYCLEAYRYSQGGIGSGYDIATSIFGGVIEFEGGFNPKCRQLGAVEFNDFYLMQGLQAIKTTTSICEYNKHRNSILDFILKCNLEMKKLVLNASNSKSALISSLRRAKELGLAIGEAIGVSAALPSSFDHLLGQCDLIKALGAGNETFLVYRPNIEAFNLSKIISIVLENEGIKFESDKC

SEQ ID NO: 453 - protein, 523 aa, Borrelia burgdorferi sensu stricto
MKYLQTVASMKSKFDIVAIVEQYIKLVKSGSAYKGLCPFHAEKTPSFFVNPLQGYFYCFGCKKGGDVIGFLMDMEKINYNDALKILCEKSGIHYDDLKISRGSENKNENKDMVSKIYSLNSRLINTIKFFLSKNKKALDYVLKSRAISKEIVDLFELGYLPFNFKNGLELHDFLVSKGYSSEVLRKSGLFSKTNPKVSILFQRLIFPIKDFKGNVVGFGGRDLDGKGSKYINLGETEVFKKRELLYGFYEGFEEIKSTKSVILVEGYIDVLAFFTSGIKRAVSTLGTAFSKEHLALIQRYADEIIFSFDGDDAGLSATLKAYQICLPFNINVSVVRMDFGTDPADVLKSEGVDSLQKILNNRCDAFEYLLDVYSNKYNLNKTVDLNAMINLFLNLINLSKVDTQKKIFLDKLSNKLGIGVTTLLKDYYRIKERFVVDNNKRNLYAHNDDSYERYLIVALLKNFSYFSIVRRNIIDSDLINVDARKVFMCFENLFENNKDFSLMDLKKNLKDTYKVSEFFLKKF

SEQ ID NO: 454 - protein, 225 aa, Borrelia burgdorferi sensu stricto
MKKPIFKENTIYSSKFDDIYYNPKQGIEESFYTFIKGCNLDLELKTKKNILIAELGFGTGLNFICLLKFIKENNITSKINYYSIEKFPLEKKTIMQISKFFAKETAYFKLMLKNYSKIPKKNLKLKITENVNLKILIGDAKIKIKEIPENVEYWFLDGFNPKKNPEMWSNEIFNLISEKSSPKCKLSTFSSARIVKDGLKLANFKYIHIEKGFGNKRHMIKAQKN

SEQ ID NO: 455 - protein, 700 aa, Borrelia burgdorferi sensu stricto
MKKMLLIFSFFLIFLNGFPVSAREVDREKLKDFVNMDLEFVNYKGPYDSTNTYEQIVGIGEFLARPLTNSNSNSSYYGKYFINRFIDDQDKKASVDVFSIGSKSELDSILNLRRILTGYLIKSFDYDRSSAELIAKVITIYNAVYRGDLDYYKGFYIEAALKSLSKENAGLSRVYSQWAGKTQIFIPLKKDILSGNIESDIDIDSLVTDKVVAALLSENEAGVNFARDITDIQGETHKADQDKIDIELDNIHESDSNITETIENLRDQLEKATDEEHKKEIESQVDAKKKQKEELDKKAINLDKAQQKLDSAEDNLDVQRNTVREKIQEDINEINKEKNLPKPGDVSSPKVDKQLQIKESLEDLQEQLKETGDENQKREIEKQIEIKKSDEKLLKSKDDKASKDGKALDLDRELNSKASSKEKSKAKEEEITKGKSQKSLGDLNNDENLMMPEDQKLPEVKKLDSKKEFKPVSEVEKLDKIFKSNNNVGELSPLDKSSYKDIDSKEETVNKDVNLQKTKPQVKDQVTSLNEDLTTMSIDSSSPVFLEVIDPITNLGTLQLIDLNTGVRLKESTQQGIQRYGIYEREKDLVVIKMDSGKAKLQILDKLENLKVVSESNFEINKNSSLYVDSKMILVAVRDKDSSNDWRLAKFSPKNLDEFILSENKIMPFTSFSVRKNFIYLQDEFKSLVILDVNTLKKVK

SEQ ID NO: 456 - protein, 339 aa, Borrelia burgdorferi sensu stricto
VFMTKPKIFSINKEKIKILIIVVLTSTFLLGIIFSNENKVARILEEKFFDFDFNLISKIETELEGTLTKLGKDWILTYNKQNIPVDNKKVNSLIKALDELQKNKLVSRDQKKHKELGIGENPSFKLFDNNNKLLTEIFVGKSGEGDSRLAYIKGSDENVYLTKNIFLSYKGNSYNTFSDTTLFQEKNTKLENLSFKIIRKLNKENENNINNNYEIISKDGLYFLNNQKMTKERPLNIIAEFKADGLEIDKSKIDDYNLQYKIEVKWSNKSVNNIEVYFNKNEENDKDILIKKDKDEYYYTTSKWTFFDVFDLEKKLTEKDDISSNDNQEDHHEHHNNAD

SEQ ID NO: 457 - protein, 309 aa, Borrelia burgdorferi sensu stricto
MINVEKVTKMYGPFTALFNVSFKVEEGEVLGILGPNGAGKSTLIKILTSFHYPSKGNVKIFGKDIVEHSKEILQQIGYVPEKLALYPELSVKEYLKFISEIKGVKKLKKEIDRVISIFKLKEVEDKLISQLSKGFRQRVGIAGALINNPKLVILDEPTNGLDPNQIIEFKEFLRELAKESTILFSSHILSEVESICKRIIIVNNGVIVADDTKENIIKNKLKEIEIELIVSKKSENEKKIFNSKNDIFSLIKLEEHEKDLNISLKLSQGKTEEDLFSYIVKNNIILKAMIPKHESLEKIFSKLTKEREK

SEQ ID NO: 458 - protein, 124 aa, Borrelia burgdorferi sensu stricto
LDLQIITNCNKLSLNMELNEYQEKAKKTAKYKNKKEELILTTLGLAGETGEVVEKIKKLGRDKNYIIDDEYLISIKKELGDVLWYLSSLSNNLGITLEDVALTNLKKIQKRHENGTINGEGDDR

SEQ ID NO: 459 - protein, 348 aa, Borrelia burgdorferi sensu stricto
MTMLPKIAKEIINEYDQKILPNAILLLGEKFSSKKISAIELAKKILNGKNLTNPNLLIFSNLDTVEAKAHLSTNSQKIANKYLEYIKTVIFTKCYFSNEKNLKKIEKNINYINSVYYEKEYNENIKNELIKNIENINKELNHSITVYDVKKIQTWIFSEKEKPKVIYINEIENLSFNVHNSLLKILEEPPSNIYFILAARNKNKIPKTILSRLRVYNFAKLDRSLEIQRFKESFLINKDITIEEYFASFYKEESKKIKKELAKILNIIKEKKSIFNLEEVDFIKDEQSFKIFLNELTINIRKDFLENKIDINQYLKYTEHLKNIYKYRPYNQNKKLIIENLMLNYEEI

SEQ ID NO: 460 - protein, 335 aa, Borrelia burgdorferi sensu stricto
MNKLMLMLITFATSLLAQTNKASTGLKTDQSFNNSLSESVKLKEIADIYPTNTNFLTGIGIVAGLAGKGDSIKQKDLIIKILEENNIINEIGSNNIESKNIALVNVSLQVKGNTIKGSKHKACVASILDSKDLTNGILLKTNLKNKEGEIIAIASGITQPNNKLKGSGYTIDSVIINENQNINHSYNIILKKGNYTLINRIHKILTSKKINNKIKSDSTIEIEAKNISLLEEIENIKIETNPKILIDKKNGIILASENAKIGTFTFSIEKDNQNIFLSKNNKTTIQVNSMKLNEFILKNSNNLSNKELIQIIQAAQKINKLNGELILEEIDGNQN

SEQ ID NO: 461 - protein, 394 aa, Borrelia burgdorferi sensu stricto
LRKDLIFLFLIVLIIASVVIFFIRSSKKELVYFELNTKSNISFLFLIEDLNKNLVSMQEIFINMKTGNIGFFDIPIHTGYEDLKGNISWFKDLYKKNSFNKFLSKIYTQLSHESDYYIRFQKENFVRLIDYLGGVRLLVKNPVKVYSFEDSILIPSGTSNFDGDKAYDYLRYFNDVNQFEERVEFFKEFFKRLLFQISDFGIENDSFFKIYSMLDTNLSEVVFKYIVKNYKINNDKIISINIKGQEEIFKDNDNNLIKVVFPYYGGAILKESVDKLNKELVNEGAEEIVKIVVLNGTKVVGLAKKTANIFNSLKFKVLKFGNADKNSYKNTLIINNSDNLEMAVRVGEVIKTSNIKPISEVQAKRLLELDNLDINPDVIVILGDDFDGRYVKSK

SEQ ID NO: 462 - protein, 639 aa, Borrelia burgdorferi sensu stricto
MNGNNNMNNNGKSNNKKKNKNWILGLVVVFLISAIFMSYFIRGGESYKNVPYSTFQSYLDNGLVESVVIIDKNLIQFVVKGSNFAKSYFSTSIPYLDINLLSELKNKKVELSSGKSQASLIGVLLQTLPWILFFIFFFFIFRQTQGGGGKVFTFGKSNAQKYEAGKNKITFKDVAGQEEVKQELREVVEFLKNPKKFEKIGAKIPKGVLLVGSPGTGKTLLAKAVAGEAGVSFFHMSGSDFVEMFVGVGASRVRDLFDNARKNSPCIIFIDELDAVGRSRGAGLGGGHDEREQTLNQLLVEMDGFGTHTNVIVMAATNRPDVLDSALLRPGRFDRQVTVSLPDIKEREAILNIHSLKTKLSKDINLQVIARATPGASGADLANLINEGALIAARNNQDEILMKDMEEARDKILMGVAKKSMTITDRQKLETAYHEAGHALLHYYLEHADPLHKVTIIPRGRALGVAFSLPREDRLSINKHQILDKIKICYGGYASEQINLGVTTAGVQNDLMQATSLAKKMVTEWGMGEEVGPIFLVDDEAPIFLPKEFSKAKAYSENTADKVDREVKRILEECLKEASDILLKHKDQLVKLAKELVLKETLTDKEVRELLGFEANKDEYDLFSSDSTTKEVKGEDVKG

SEQ ID NO: 463 - protein, 1465 aa, Borrelia burgdorferi sensu stricto
  misc_feature (799)..(799): Xaa can be any naturally occurring amino acid
MNLLFLRSKTFILLILPFFIFVLIIFSINLFVQAQIYSAKFFAIKYLESKFGFKIKYDKISPYFLSSIKIDGLELSLDGKDKILIDIVRIDLNLFKLILGDENIILNVYVKGSNFNFDINDFSLSGDLNPSNAYSDNENTVFNKILNYLYRLNINLENININIKLNDNSWLNFQVKNFSLSTVDEDFLFSSVVDFSAVKNLEINLPFERVDDGILDSTFYFEGKFKKGFEDGYVNFSFFEFKTSYFSLLEQGFQINYSKGNLKIFNLRRENFDFNLSYDKANGFVRLDALFFNVSLLDWIKLNKGFEIYKDYFDISLNGQLAFSYDFKDKDLRYAGIIDSSLNVDTIGKEVQGLQLEIKGDDRIVSVKNAFLKLKRGVVNYKGYYSLKDLLPMGRLNFKSAKILNFNDLNGYLDFNKDKDIFSVKSDNFSLGNLSFQNLILKTYFLKDKIFVDYLIYLENKNSQISLKGDLNDEEFSLSLGIKEFPLLFLKEVIPSSHLINFFPKTLFSGKYLNLVSDFNFNKFNYHKNKLKKFNFMVFSKLDNFKFVLDASGEKNFYKSNNFDLQYNDHNLHSNLFVELFESGFNISTNFSYLNKVYPLHFNVNLKDKFIVAESPLGIKLDFNYFDSKVVYTLNVNDFKVYNKTSDLLININFNGNYLGLNEDLKFKIDEFNIIKVSKTPAYNFNFGFKGLYEYDKLYISDVKLINKLSNLQGYGQFNLKDNFNGSLNLFSSLNSERYFLGVNSDEYGSYFLLKFQDLDFYNFNSFSLLEGKVNGNFLLNFKKNDFKNYSLSGYLEAXKLTFLGVPVQFSMNLGLLDNKLNIYDIKAKRNKKEFLTGSLRYDLSSSIGVSNIVFNSDLFSYRFNANFRNFQSGVEEQFGVLKTKTEGEFFFRDIKYKNESLSNLTIEFSNDFEKFNMASIDYDLVNVLYHYGSGEYSFILKDYLPLSFNSSGKIIKNKILGNVRDIKFDSKIITKDFLDSHSLFNVDNHFILYDLVLNGEFDIDGDLYNPNINGSLNIQKGSISTEYLRASRKFGGDRALEIFDMPVAIQDNKIIFSNEFNLDRYSKIFVSTSLNLNFLSDTIIDYYKIDINVTGRTGVPIKFEKIALSFTGYALGDFSIEGNADEIMFKGILNISNAWVYSLESSVVDLLINPFKRAKRLQTDINLLDFDILTDLEINFDSGVTFHWPDSNISFLQATISRGDKLVIKSDTKTDDFIIKGDLNIASGFVNYNNKKFIFKSGSYISFNESRAKFDPWIKAEATNTIKDRNDKLLVTISIDSPLSLWKIEFMSYPSRNEQEIKYLLSGSTIGGYEGGLRSAGTNAAEMAIGIVSDIALDFLIQPIEDYMRSVLNLDLLSIKTDILKNSINSNFFKIGNPTFVDVLDNTSVKVGKYLVEGVFISGGFGFLKEQMSPFSKDLNFVVNLGIEFDSPFFLVNYEFDYNFMKKGLDGIGNNIGISWKFKY

SEQ ID NO: 464 - protein, 185 aa, Borrelia burgdorferi sensu stricto
LINAMEKFVFFLILPLFFLLSFNVFSIDVIKIGIVDFDRIVIEVLNPQLKANLDQIKNRYQEQINTLNLELKNLKHMYDKSIADNDLDNARSFGNQYNLKVDELKRVSSLAKNNLEQQRLANINSLNNNSESLSKILRGIQYVAEINGFSLIMKKNNPYILYHNSTVDITNDVVKHLLEKDNKNP

SEQ ID NO: 465 - protein, 274 aa, Borrelia burgdorferi sensu stricto
MLKTLTKIITISCLIVGCASLPYTPPKQNLNYLMELLPGANLYAHVNLIKNRSIYNSLSPKYKSVLGLISNLYFSYKKENNDFALLIMGNFPKDIFWGIHKNRNTESIGNIFTNPKWKLKNSNIYIIPNKARTSIAITQKDITAKDNNMLTTKYIGEIEKNEMFFWIQDPTLLLPNQIVSSKNLIPFSSGTLSINSLNQEEYIFKSLIKTNNPPILKILSKKLIPTVLTNMTNLTISSHIKTTIKDQNTVEIEFNIQKSSVESLIEKLASNIQT

SEQ ID NO: 466 - protein, 323 aa, Borrelia burgdorferi sensu stricto
MKKKNLSIYMIMLISLLSCNTSDPNELTRKKMQDKNVKILGFLEKIQADNKEIVEKHIEKKEKQMVQAASVAPINVESNFPYYLQEEIEIKEEELVPNTDEEKKAEKAISDGSLEFAKLVDDENKLKNESAQLESSFNNVYKEILELADLIQAEVHVAGRINSYIKKRKTTKEKEYKKREIKNKIEKQALIKLFNQLLEKRGDIENLHTQLNSGLSERASAKYFFEKAKETLKAAITERLNNKRKNRPWWARRTHSNLAIQAKNEAEDALNQLSTSSFRILEAMKIKEDVKQLLEEVKSFLDSSKSKIFSSGDRLYDFLETSK

SEQ ID NO: 467 - protein, 169 aa, Borrelia burgdorferi sensu stricto
LKKTIIVFIILAFMLNCKNKSNDAEPNNDLDEKSQAKSNLVDEDRIEFSKATPLEKLVSRLNLNNTEKETLTFLTNLLKEKLVDPNIGLHFKNSGGDESKIEESVQKFLSELKEDEIKDLLAKIKENKDKKEKDPEELNTYKSILASGFDGIFNQADSKTTLNKLKDTI

SEQ ID NO: 468 - protein, 282 aa, Borrelia burgdorferi sensu stricto
LKRVIVSFVVLILGCNLDDNSKMERKGSNKLIRESGSDRRGQENRALGAMNFGLFSGDSGVVYDLQNYETLKALENKNKFIDYSKIEFLEGTKSINAFIWAVSVRWIKIKARDLFGECGDFIKELKGIKYSYLVSPVDGSYISYAMPIIVFETTRESDPLYSVSGFKLISKGNDINFNENKSGFWGRLPMSEKSVESGLVTAYPFGSSDAKKVIEAFASLYNNGTWSDMIAEITIKSKQYPKNEKVYRITLDSQLFNVAMKKIIEKYPKIKSASFAFNSLIN

SEQ ID NO: 469 - protein, 181 aa, Borrelia burgdorferi sensu stricto
VEIKINKRNLSESVREEEQALVHYNKLKEKLNINFQKEIYCKIEAMKVLKEIKDKEYYKLDNYSSFDDFAKDYRLARTQTYKYLKIATAIEEGLIEEKYVVKNGINDTICLLKTKESPSLKKSNQNPIKPLRFQLKKEEAYSFYKKNPKLTSFLLEKIFFKEKDFLLKIIKEFETLRNKRK

SEQ ID NO: 470 - protein, 191 aa, Borrelia burgdorferi sensu stricto
MIKCNNKTFNNLLKLTILVNLLISCGLTGATKIRLERSAKDITDEIDAIKKDAALKGVNFDAFKDKKTGSGVSENPFILEAKVRATTVAEKFVIAIEEEATKLKETGSSGEFSAMYDLMFEVSKPLQKLGIQEMTKTVSDAAEENPPTTAQGVLEIAKKMREKLQRVHTKNYCTLKKKENSTFTDEKCKNN

SEQ ID NO: 471 - protein, 529 aa, Borrelia burgdorferi sensu stricto
MIIKKRGLLILGIATVISCSAMSKPKDDIVFGVGIGNEPTSLDPQFCSDRLGNLIINELFVGLLRGDPKTGGYRPGLAKNWDISYDNTCYTFHLRDDIYWSDGIKITASTIRDSYIMALENELDVPHINLLTSKIKNAQEFYETKLNADEVGVKVINEQTLEITLSRPARYFLDMLTHPIFIPIPTHIVKKFGNKWTSSENMVTSGPFKLKRRILNEEISLEKNEKFYDAKNVAINELIFVTINDTRRIYSMYEHNEIDAIFNNIPLSLINELILREDFYSADINQIGFFSLNTNVKPLNNVKVREALALAVDRETLTYRVLDNNFKATRKISPNINNYNYGKKLKPYNPRKAEKLLAEAGYPDGKNFPTLTIKYNKNDLEKEVASFIQSQWKKVLNIDVEIEPETWVNHISNILKGQYEISVRSWQGDYLDPMAFFNIFETKNSHFASYGYSNPELDELIIKSDLEEDEKLRLEILKKIEEIIIENDYPIIPIYSVAGNYLFKNDKWLGWNTNNSERFALSEIKPIEE

SEQ ID NO: 472 - protein, 217 aa, Borrelia burgdorferi sensu stricto
MKGISILSLLLLAFSCKQYGSVKALTEIASDSGDNNSLVVSDNLAAKELIAEKGPTLTSQESERLEALKTFLKDAMGVNGKTGDTKAEYDKSYKEFFDWLSKDVNKQKEFVSCFNNICGIVTKAVDASKQRYKGNQQSLGFNEYVCYDIKTRTGDDLSLFFQKVADAFGAEEYKKKDDESSQKPEKCNEEIFKVIKRVFTESDSNNELKNLKNHGNI

SEQ ID NO: 473 - protein, 414 aa, Borrelia burgdorferi sensu stricto
LNGKLRKALKIAIFTTLLLVISCNANMDTNDKNKALNEYKLKNISEVIKNSLQLESDPKLKKEPESNINQSTPPILEIEKIEPGKQEMSLKSEFGSESLMPLEEPEEANMAKSEEEIAKIQEKLLLIGASDEITDQELGENMQKFLNPTTVEFKISTTTNETILTTIEEEEINNNKDKIFDHKEENVTLGNNSLENATLNKNTITLAQNQKYTTHLKNDDKFITKEYLKQVRDSLDKALNAIKNLETSKEFRELENLPKDQENSPSAKKESTESNINNTNTENIEIIKNRLLEELNKSELIFEDTKDPLGTSTIKKVIDAAKKWQEKENSSQIDWDLGFKFHPNPKFYNKLTAQEYKVLAEKFTKVKNEYKNTKEQLKAESKLTTNSISKIINATKEFANQVINLILLVEKNYQ

SEQ ID NO: 474 - protein, 296 aa, Borrelia burgdorferi sensu stricto
LKRNKIWKTLKLFQITLLFSCSFYSKSNNTEAISELQSSPIKLGKIKVLQKTEKIVSTQNLQNLQQSQFFKNEKEKIIKKIAQEFDENEKLINKIGPNIEMFAQTINTDIQKIEPNDQFGINKTLFTEKKDNNIDFMLKDNRLRRLFYSSLNYDENKIKKLATILAQTSSSNDYHYTLIGLIFWTGFKIQEAFESAVNILTKDEQKRLIFNFRTKTVKEIQENFEKLMQERNSWIKIVDNIIGEYDKNTGGCKADGKILGEVIRVGYEHELDSNKSMQILNNIETPLKTCCDHIHY

SEQ ID NO: 475 - protein, 365 aa, Borrelia burgdorferi sensu stricto
MKEIGISIYPNVSPKNKIIKYLEKSAHFGFTQVFTSLLYINGNEFDIFKELLSIANKNGMKPIIDVSPEIFKELGIDLSNLRNCPKLDYFKKLGAWAIRLDNTFTGIEESLMTFNDSDLKIQLNISNINKHIDTIMYFKPNIKNLLGCHNFYPHKYTGLSRNFFKETTKIFKHYSIPTAAFISSNNAEECARGKEKEGVPTLESHRSKDIETQAKDLFKEGIDTVLISNCFPSETELKKVSKVNRNILELKADLNPDANSVEKEIILENLHFNRGDINSYRIRSTMPRVYYNNKKFPVHSPNEIKKGDILIDSSEYLGYTGELQIALKDTPNNGLVNVVGKIINDEIYLLEKIEPWEKFKIIENK

SEQ ID NO: 476 - protein, 530 aa, Borrelia burgdorferi sensu stricto
MKILIKKLKVVLFLNLILLISCVNESNRNKLVFKLNIGSEPATLDAQLINDTVGSGIVSQMFLGILDGDPRTGGYRPGLAKSWDISDDGVVYTFHLRDNLVWSDGVSITAEGIRKSYLRILDKETGSSFVNMIKSVIKNAEEYFDGKANESELGIKALDEKTLEITLKSPKPYFLDMLVHQTFIPVPMHVIEKYGQRWTDPENMVVSGPFKLKSRVLNEKVVLEKNNKYYNSKDVVLDSIIFFVTDNSITAYNMYLNDELDAIFKNVPPDLLKDLKLRDDYYSMGINSTSFYSLNMKVKPLDNVKVRKALSFAIDRKTLTESVLNDSSIPTRRATPDYIDYSYKSNLSLFDAEMAKKLLADAGYPNGNNFPLLKVKYNTSDSQRKIAEFIQNQWKKNLNINVQLENEEWSTYINSRVNGNYEIIRSGWSGDYADPMTFLSIFQTENTSFSSYGYSNSEYDELLIKSDNERDIFKRQEILKKAEAIIIERDFPAVFLNITSSSYLFRNDKWKGWEPNISERFNLSEIKPIK

SEQ ID NO: 477 - protein, 404 aa, Borrelia burgdorferi sensu stricto
MPNKITKEALTFDDVSLIPRKSSVLPSEVSLKTQLTKNISLNIPFLSSAMDTVTESQMAIAIAKEGGIGIIHKNMSIEAQRKEIEKVKTYKFQKTINTNGDTNEQKPEIFTAKQHLEKSDAYKNAEHKEDFPNACKDLNNKLRVGAAVSIDIDTIERVEELVKAHVDILVIDSAHGHSTRIIELIKKIKTKYPNLDLIAGNIVTKEAALDLISVGADCLKVGIGPGSICTTRIVAGVGVPQITAICDVYEACNNTNICIIADGGIRFSGDVVKAIAAGADSVMIGNLFAGTKESPSEEIIYNGKKFKSYVGMGSISAMKRGSKSRYFQLENNEPKKLVPEGIEGMVPYSGKLKDILTQLKGGLMSGMGYLGAATISDLKINSKFVKISHSSLKESHPHDVFSIT

SEQ ID NO: 478 - protein, 212 aa, Borrelia burgdorferi sensu stricto; identical to SEQ ID NO: 225

SEQ ID NO: 479 - protein, 369 aa, Borrelia burgdorferi sensu stricto
MENSKKNTLCQNKTQHKSIVLISTLEYINKTHNKYTQKNILYYFNENLKRNGQLPVKIKTLQNYLYKLEKEIKVTTNYHKHLGVNCGTEIYYQLNFSKKECYQKIYKYFQEKKDLRFQNRATRGLKDRFTKNGSVDLKECLNNKNNIKEERKINEIEKYQVRNYFNKCNFLCKKILSIFLTILFNLDIDKDNIIKILKIIKIIEIKLLKNKNIHFTKSCMKEKQEKLKKILCNTQKEFEKNEYNPKQLEISFQKIYENYKFKPHFIIESHKYSDLNNIKRKLEKSIERKKENSQQNYQDLKTNIFNILIEQLKKEVNIELLKPIIKEYLNNQKKIEYNKVFCTYYCELLELIKNQKSLLNLKELDRKAI

SEQ ID NO: 480 - protein, 1098 aa, Borrelia burgdorferi sensu stricto
MKLDEIIIPLSMSISNNQKLDAIAETLKKIAEQKFSSLDDLKSKLEKSAKSGSNLEKALNKSSQNAIKNFKSLANSVNSVNSKAGSMKSIGKVLKSVGKGLGSVKNLANKTGEAFNQMLAAFAPIIMAVKAIQAIGSTISGIFDGAMDALDEFNEEVSTFSDMLGNEDLGKSLAESMRAFGDETLFTRDAIANATKTMLSYGATASEVEERIRMFGEAAGGSSEGLEKLAEVYSRVESSNQVNLEDLYALRDAGVDITDILAEEAGLAGEALYKAASDGKIGFDALNKALSKATSEGGKFYGNTAKEAKTLAQAQQQTAKMSEKLFLDIGKALEPMMIGFEKVKQFLMVAIMVPLTKVTTATIYLTTKLGELVAYLAGKWVQGMKMLFKAITTPFVKLYEGIKYVIGKLKELATYVSSGFLDRFKGAFEPIIKWVQKLIDMISKAYTKLKNLVTFWKKAEKEKDTSGSEPERDKKFDPNAKTNINKKMAEDYQKLQDEIFNRQRDIYNKTGKAREQALRNLEKTINEKNQKFKDEYSKIFDQLTDENKKILVGVEKSVNEFNNSNYDFVNEYQNLLKEKESREREIIKTLPHTDQVSALQKLNDEINEKNKAFVEKYGKSFETLNESNRQVVVALEKQVNEYEKTALDRSFVEAQKALQKEITDLEWETMLLPAKERASAEKKMASKIQAMYKKFVDEHKSQFKKLNETNRNTIKQYAEKAQDTTKSLYDSMIDGLNVFKNAFMKDIAGKFLNKDTGESIGEEFHNLINGKDVNWGEGLEKMTTQMYESWKTGLKTAAGAVFGPWGEAVAELINGLTDFVWGILKGQEKARIKAIEKKRDEDLEELEKRSEVELKKLEDRFDEEIKMRKEKLSELDDEYTKEIEFLKQAQSKGQISGEEFQKRLHDVQTEYKTKKDIETTQLTKTEEAKKLEVERKNKLSKLEPERIKAQAEVDKVNAEDWWNLGKPDRLRKTQKILDEILKRIAKVKSAGSIEEIKLAHGGARFVSNKPTYMPNSGVMSSEFGQPELVRITPAPIDENLRKLEAKIIAEEITKLQKTQSSTVVNNFYYNFNGDVLDAEKLVRMLKSKEHLMGFRMAE

SEQ ID NO: 481 - protein, 142 aa, Borrelia burgdorferi sensu stricto
MVINVNLTGRVMLPYIPDYIRNGKEKIKEEEKAYVVLKDINYGFVENLKARQIELFKKLNGENGKTNSNAMIESTSAQIQFVKKIWDENVVGFVGLENQQGEVITKEMVEGDAILFQDMLSSLAIEINFLADTLRVERVSKK

SEQ ID NO: 482 - protein, 396 aa, Borrelia burgdorferi sensu stricto
MRLRRLPVYVDAYKEKPNAEIFIYYSSRGTGKTYDIATVNLERKFSADGGDTLAIRKKKNKTTQSIHKEILELLSIYNLRKFFNISKAKIESKSLIFGKKRAFVFEGGHDTRDLKSYAHFKDLWLEEANQFSADDIEMLVPTMREQGGRIYMSSNPVPKSHWLYKRYLSNQDNPAVCIIKSTYRDNPFLNGGDVQAWLEKQRLAYHGNDIGFRIEVLGEEFDFGTARLIKKFNVCGPEILSRANGSYYTGIHVKGNRICFLEILVGRISYLPVVIITNACSKVLLSKTDYQSEINKFKGVFVLPTAREELKYVFSRFGRGTLLAKKRNLYSLSDYLIPSNLNVVNKPETTDVISEFNETEYYYDESSAEDSEVTNFVMQKDLVYIPAFLNAISVFS

SEQ ID NO: 483 - protein, 260 aa, Borrelia burgdorferi sensu stricto
MLSDDDFENIKKRLQADNIKIQFGVGTMEEAKNYVGKLGEPIVVKDKELFAICNGKDTTNRKYYPINKNTKPPIGENIDDYLKDLVNWCLENTYPGFLTAEFVEQGSISRSKLVQAFEDTKKFCIPDGRPLPDNCFVKEKFGISLAPKLSGRFLRHYDSGGSTDSDGTRSLGHTQEDSYKSHDHDLDLSVLDSLRGRLVTDYSSIRRDSNWSTGSTSFVTHIEYGEPIQSWRYPSYTKYSGDDETRPKNTCYISFYRYDW

SEQ ID NO: 484 - protein, 896 aa, Borrelia burgdorferi sensu stricto
LYLGVTKNTAEDKDCIKLKDQDNSSQESEALNQETEKGAETEEISNPKEDTSENCTSLGLDIVFYTDEGQIFELTPFVDTTSIVLEEKIVDPSLKTAASTFSFSVSGLSEEFLNFLFFRNEDIFVKVNDKNNPVFRGILEKFFSRDLFNSTKSVSFTVNDYSSLLKIAFENPVQFPINFLPDWLFVYNPLAKELSLVHLIIEKTKLKDLIDDDASEAILDKVPAVIIDSGEDVETILQALLYEFGYAYTFSSVGKLQILPIWKSEVITKEIEICTVDAESYVMSKSSSSSYDSTKVIWREGKFQSKEEAMSKKRPLYSAPINVAGTDGALYVAVLQKGVVYPDFADKVGSSVFQEYDPSWLDTVYKWDFKRREVWHDHYAINEHLAIISTHNLEVRFSADSSIKLENKEYFPTKAKLWFRNTSSSQGSKYIYHFDIYGDVFYTIAQNVLQTDNADDFYSKKFEYTTRFIFSEDSALRLFEFLTNLRVKGHTIVNFRSMQNLNITDFVKLRLDNIGIDHFFLILSKKITNFDLDIKLYEYEGITWGDYTHYEYLTTSTKIGISDYLSGAHKVVIAPFNYDGAETYQFKASGFKDENTLNGSIEFAKQAGLNKIKLLKGDFYIYDQVKLNNLEIEGDDEVFIRSTGFSKHIFTSEKSFRLSGVNICQQPMSELYINGGDLNQQELAPYLEDKSFTQPAVVVLCSSYSLQEEARSSVYVTDASFVYIKNVTFTCALNKALHFKKTKKILLEDVNFDSTNQSFDIENVTNLTLINVNAQGSKTASVANGLNAIIRESFFTNNTNALKLSNFSSLKITDTQFIKNSGTALHLQDITSARLSNNTFTENKVGLENHAFDLIVRDTFVKNTLALNLARKSNAGVRTLDLSTYMENTKDKQEVA

SEQ ID NO: 485 - protein, 142 aa, Borrelia burgdorferi sensu stricto
VALGGKMRIRMKHLVRRLYLRRDKIWHVYRSTEIQNKAKDKSITNFPKLEPEDFDYEYIYKFVDEWIQKKYNDKLGFTIQKVDGLEYICKAKRYASLKKILARIVKDYKDIFLGRLQKNVAGAQAGSGGSGGKGSKPAGTGG

SEQ ID NO: 486 - protein, 222 aa, Borrelia burgdorferi sensu stricto
MKAVLATTNITEDQIYREFLRLGMEQLIAQDLSKRYYHNELTYRDLENLEKQFGIRFENLISEISFLEKNLQKDIFNLDAKIDSVEKNLQKDIFNLDAKIDSVEKNLQKDIFNLDAKIDSVEKNLQKDIFNLDAKIDSVEKNLQKDIFNLDAKIDSVEKNLQKDIFNLAQALKKEVQINSQFLLEKLKVSNRIIIIITVIIVPIAISSITNIVMLLIAKFFK

SEQ ID NO: 487 - protein, 1277 aa, Borrelia burgdorferi sensu stricto
  misc_feature (186)..(186): Xaa can be any naturally occurring amino acid
  misc_feature (573)..(573): Xaa can be any naturally occurring amino acid
MKTNDIVKTNNPNISLYKQLSKDFIKKENINKLKDFFILIKNKLFSIDDNSTEANIESLLKYIFEELNYSVEQQKAGQIEGVESRVDILLFENDKDKASFNNKLKEAKKNNEPIPIEDILIIAEVKRPTFSFDAKDKLKESEDQLYRYLNQYQKHYGILSNGKVWRLYDKSKVLYGEKRYIEFNFXKIEEKEEYKEQEWFVLFIYLIRKERYLKTSNVIEVEKEQIAKEKEIIQKTLKEILYERPDDSIVFKIAKNIYDKEFKLSGKEITQHILASILEESIIFILRIFFIAYIEDNDIFKKILQENKLYRSSISFRYFFYDENTKKKLEYKKIITIFNLLDKGSDAIKFPVFNGGLFSEDKVKYLNNEGLLSISEIEEILVKMLFFEEKNIKDEKFVKYSRLDPKSFGELYETLLEYDLRIADTTVHRIIEDGVYLIRTEEELENKKVNKIATYLKGNIYLTSRSLDRKKSGAYYTPDDLTDFMVISSIEEQLKTKSPLDIKIIDNSCGSGHFLISCLDYLTEKVWYELDKFEDVKKELDEEYRVIIEESEEYDVQDSISKELVLKRMLLKXCIYGVDINPISVEITMLSLWINTFIFGTPLSFIEHHIKAGNALLGYTKDEFFDIVKKKFESGFSLFKKRIKEIITILEDIYQKIKGINDTTKEDIEKSKKIYKEYEESKDIDNLRIIFSLIKLYSLSFDKSLNMEFSDIASVISLIENILGNKTSSEDKEKIEKIRKLSSYYKFFHYGIEFPDIQEGFDIVIGNPPWEKTKFNETEFFSKHIPNYRKLGIKEQNIIKQEILSKDNHPLSIEYNEEKNSIIAINNIYKFDFKCFTSGGDPNLFRYFVTFNLKLIKEKGNLTYLVPSAIWNESSSRILRKHIFARYKLNYIYQFENKKRFKDVHSSFKFAIFQLSNIKESTSSFKAKFMIQSSDNILKEITRDLKDSKDDAYKGIELNINQIKKLSPIQESIIEFKDNEEFTLINKMFSKFSALGEGYIDFKKGLDPSIKNRKSLLKECNNKNLIFLYSGANIHQFNSRFFEDKDAKESSKLLWIDKEDLEKVLTKDNQYQTERVFYRAIASNTNERTMISTLSPGNCYCVNSIYINDEKTPISLYKKLFIISIFNSFVFDFLLRRFVDSNVLKSCLYQCPMPQPEEKEILSNPLYLNLAKNTSLLIAKNDPENFKYLLYLEYFKFDKEKVNKILKLDKEDEFFKEKENENNFIIASLYSLAKEDFITLLGDFKALKNKKKGEDYISSLIKGYDNYLLNNKIFYHK

SEQ ID NO: 488 - protein, 278 aa, Borrelia burgdorferi sensu stricto
MKNFKLNTIKLNVITAILTLICISCAPFGNVNPNKLKNPITSKNLKKPKRSNHSRNLKKTNSHTNSENSAENNQNLENESQNSKSSNQNPQEETAISKLEKIGKDLEAQKKEKDTQIEKISSDAQYDFLENFKLHNYDYFMHNTKMTLKKIIYSSLNYEKEKILTLKEILEKLDTEDNNRRIAGQFLETSRDIQLQQEDLILKKIQDTLQTLSKEKAEELLQHAERDLKIKQNFVKALNATIEAYNKNSDNIKIDNKALANHMEKKYSHPLYLLDQAD

SEQ ID NO: 489 - protein, 354 aa, Borrelia burgdorferi sensu stricto
MKKVKSKYLALGLLFGFISCDLFIRYEMKEESPGLFDKGNSILETSEESIKKPMNKKGKGKIARKKGKSKVSRKEPYIHSLKRDSANKSNFLQKNVILEEESLKTELLKEQSETRKEKIQKQQDEYKGMTQGSLNSLSGESGELEEPIESNEIDLTIDSDLRPKSSLQGIAGSNSISYTDEIEEEDYDQYYLDEYDEEDEEEIRLSNRYQSYLEGVKYNVDSAIQTITKIYNTYTLFSTKLTQMYSTRLDNFAKAKAKEEAAKFTKEDLEKNFKTLLNYIQVSVKTAANFVYINDTHAKRKLENIEAEIKTLIAKIKEQSNLYEAYKAIVTSILLMRDSLKEVQGIIDKNGVWY

SEQ ID NO: 490 - protein, 324 aa, Borrelia burgdorferi sensu stricto
MGGFNMELFDENYYAKAVANIIGEVKDPIMYKWFSPDQIEDVDLQMGYQRTVKWDAFLNANPTTIANEVNTISTIGFSSEVVRLNYLKLQYKFRHLKQASEKFYTSDSYLGDINNNLLPFSQAYKLASSEIIKLINHFVLTGTVSIQKDGKNQKRLLPNMYGLLNMPHQVKEEVASGDKDKMDKIFEKIEAGLSKLELGDEFSTPMMVIVDPTTSLKLVKPYAAAQGAASSCEKWEDVLIQTIKAINNREDVYIETSNLLKHQILIYPLNPELIKFKPSKYMLPTPNEQVDKDSTDIAHSYIDFVLGGLLATRKTILQVHIKQS

SEQ ID NO: 491 - protein, 238 aa, Borrelia burgdorferi sensu stricto
MTIRENFMETVSTNIASVTQEQIYKEFIRLGMEQLIAQDLSKRYYHNELTYRDLENLEKQFDIKFDNLIFKIDSVEKNLQKDISNLDVKIDTVEKNLNAKIDGVEKNLNAKIDGVEKNLNAKIDSVEKNLNLKIDSLDTKIDTVEKNLQKDISNLDTKIDTVEKNLNVKIDTVKSELNTKIDNVEKNLQKDISNLDAKIDNVEKNLMSLTEMLKWVLGIMGAMSITMIAGLIFAFISK

SEQ ID NO: 492 - protein, 187 aa, Borrelia burgdorferi sensu stricto
MSDGITKIKEEFDKKVAEIKALMKNPQQDTGLLSNSVDFRDKNLIYSNSDGVFTSSKDKIENYPAKGYPYKRGVKLSFSADGTTELEVEAGGGDDLYGICTDIDEFTGMATVVPITNNFTGYLTFKKNGNGVNPGDKLHFNAQGELEKNGGNDKSVNAIALSKVHKLTEELSIVLASVFGNRALKGN

SEQ ID NO: 493 - protein, 431 aa, Borrelia burgdorferi sensu stricto
MSDKFTIKFKGILDHAATKKAIEQDISKMEKYLKPKKSSLGSTKDIVKNNLSDKKKELSRQSKFESLRERVEKYRLTQTKKLIKQGMGFEKARKEAFRRSLMSDRDKRHLEYKELAKESKAKSKMLAASQGKGLVAKIAIGSALRNIISNAMSKVGGGLLGFAKKAVEEDTKTKRTKLLNSAFFTDNERNMIMGNKDKNTKGILDGMKGFERDLEKEEFLNQASVFKGTLRDLDMLNETNLKNAVEFAAMLKSSGAMSSEDAVKAVNSVLGGDGSELFDLLKKSGVGDKYIEDAKMAWQSGAQVDLDSRITKMMEMFKDFKSFGLTKKVNNAESIQSNLASAEQTLQNLTTTVLDPILGLVNKITKYFEGFKFETHIINPIIDGIKSIFNLNYFFAKLKSMLPGWMGGDEGAALKKLQEEVQNQDNANNTP

SEQ ID NO: 494 - protein, 256 aa, Borrelia burgdorferi sensu stricto
MEQLMNKKMFIICAIFALIVSCKNYASGEDVKKSLEQDLKGKVKGFLDTKKEEFFGDFKKPEAKVQPKDEESMQADEPQEQGEDQVVQGVAEDQKLKEEIEQKIKELKDKIEKSDPKSVSLKTYSDYEKEIEELKEKLKDKEKFEKELEILEKALNEKIEKRKKELEESQKKFEELKGQVESAIGITDGERAKNQGKVGIEALRHARGLGFKNISSGNSTSDIAKEIIVSSLKKIEEELEELKKLEKESKDSNKKE

SEQ ID NO: 495 - protein, 179 aa, Borrelia burgdorferi sensu stricto
MRNLVHRTYDIESIKNEFLNIGFSEEAIDFVFLHNDNYNYEVLKEKIIDVEKNLQKDISSLDTKIDNVEKNLNVKIDNVEKNLNIKIDSVKNELNSKIDSLDTKIDNVEKTLQKDISSLNTKIDSVEKTLQKDIFSLDNKINVLKNELTASNRTIQVILIMGITLAPIIYSIFNKHFLN

SEQ ID NO: 496 - protein, 229 aa, Borrelia burgdorferi sensu stricto
MNKKMKMFIICAVFALMISCKNYASGENLKNSEQNLESSEQNVKKTEQEIKKQVEGFLEILETKDLSKLDEKDTKEIEKQIQELKNKIEKLDSKKTSIETYSEYEEKINKIKEKLKGKGLEDKFKELEESLAKKKGERKKALQEAKQKFEEYKKQVDTSTGKTQGDRSKNRGGVGVQAWQCANELGLGVSYSNGGSDNSNTDELANKVIDDSLKKIEEELKGIEEDKKE

SEQ ID NO: 497 - protein, 149 aa, Borrelia burgdorferi sensu stricto
MKIINILFCLFLLMLNGCNSNDNDTLKNNAQQTKSRQKRDLTQKEEVQQEKPKSKEELLREKLSDDQKTHLDWLKTALTKDGEFDKFLENDESKIKTVLNHIKSELDKCTGDNADNNKNTFKQTVQGALEGDIDKFTEQSDSTCGGGNS

SEQ ID NO: 498 - protein, 183 aa, Borrelia burgdorferi sensu stricto
MRILVGVFIIAALALLGCYLPDNQEQAVQTFFENSESIDMGSDEIVTEGIFSSLKLYASEHRLLVEIKKTLISLKDPNYRDVPPVRDYNEEYFNKFFLDLGSEQSKDLIKLFGRVKNEQNNKFKSEVYWLYSCISELYSPDIKYSGEEGSPEYDRFMPRPTAYQQYLKVKREIERNTINGKIL

SEQ ID NO: 499 - protein, 111 aa, Borrelia burgdorferi sensu stricto
MQNNTIGLGLNLLSSLTNIAKTDTNIDHNYINTFSKVIDFFYKTYISTLKSMETAESTKIFEEIQDILKYNIEIIEAISTDKSKRIITSLKATRNKIMKEYIKILKRGENA

SEQ ID NO: 500 - protein, 209 aa, Borrelia burgdorferi sensu stricto
MTIRENFMETVSTNIASVTQEQIYKEFIRLGMEQLIAQDLSKRYYHNELTYRDLENLEKQFDIKFDNLVSKIDTVEKNLNVKIDAVKSELNTKIDNVEKNLQKDISNLDTKIDNVEKNLQKDISNLDTKIDNVEKNLQKDISNLDTKIDNVEKNLNAKIDTVEKNLNAKIDNVEKNLMSLSEMLKWVLGIMGAMSITMIAGLIFAFISK

SEQ ID NO: 501 - protein, 92 aa, Borrelia burgdorferi sensu stricto
MSNLAYNALKIENIRLEFLNKGFSEEAIDFVLLQNDNYNFEVLKEKMNSLEQQIINVEKNFQKDIDSVNTKIDSVEKTLQKDISSLDNKIDI

SEQ ID NO: 502 - protein, 186 aa, Borrelia burgdorferi sensu stricto
MSIKNKMIITKRIDIKENMSKMESLEEIHKEEYLRLKDKLKTLTTDDIYNKIETAKILNAINQKKLYILDGYKNFYSFLADFKIAKSQAYKYIKIVSGVEKGIIDYNFIANNGIEKTIKQLESNNVIKKSRQNPIKPLRFQLKKQESYDFYKKNGKFTGFLLEELLESQTDLINKLLKKYKQLKGY

SEQ ID NO: 503 - protein, 180 aa, Borrelia burgdorferi sensu stricto
LDIKVNKRDLSDNENYIITDSVLNHYNSLKEKLKINSKKEIYCKLETLKILKEIKDNHYYRFDGYKSFEAFSKDYRLARAQVYNYLKIANAIEDGIIQEEFLIKNGILETLIVLRNKESKTIKKSKQNPIKPLRFQLKRQESYDFYKSNAKFTGFMLDKLFSDGKEIIKKLMKEYKELKG

SEQ ID NO: 504 - protein, 162 aa, Borrelia burgdorferi sensu stricto
MFTSSQVSFQILFQINDKFFYVLHLSNFADSFTKSLVQFVYWFLGFLFFKDSQMGTAEDSIPLYAAQLLIFVRLGAGKLLLYACPESRNSERGEPTFTFKLIPKEVSSKSIFVTFDNRPGICDFKESDFCRILKPTKLFALSNIDFLIFSPISICYPFGQPI

SEQ ID NO: 505 - protein, 184 aa, Borrelia burgdorferi sensu stricto
MRILVGVCIIAALALLGCYLPDNQEQAVQTFFENSESSDMGSDEIVTEGIFSSLKLYASEHRLLVEIKKTLISLKDPNYRDVVRPVSDYNEEYFNKFFLDLGSEQSKDLIKLFIMVKNEQNNNKFMRIVRWLYSCIEELYSLDIKYSGEGSHEYNRNMPRPTAYEQYLKVKRYDYNSPVSILPT

SEQ ID NO: 506 - protein, 181 aa, Borrelia burgdorferi sensu stricto
MQEQINEETVAISESLPKNDKELVTISSEEYERLVADAKKLPDMISREDFEKRLAEAESNFIKARKQAERQAEANAFKDSKILSNLEKACEQYEIAPPFANVLSVKDAKLAFLDAMKKKYNIKFKIDEEGDLDSQIDNISLLVQELTAYKQMVNARNRFTGQIINETKLQKYKDRFALGRA

SEQ ID NO: 507 - DNA, 1968 bp, Borrelia garinii
atgaattttaatcgatttttaatgttattcctttttaactttagtgttctattgggcagtgatactacagcattaggacattatcaaaaggctcatgaatattatttatctaaaaggtattatgatgctattgatgagcttgttgaggctataaaaattaatcccaattattatgaagcttataaatttattgcatcaatttattattctcttaagatatatactcaagcacaattttttatagaaaaagcttataaaatgtctaacgaagacattgagtataaaattctttatgcaaatatattattaaaaaataataaaattgatcaagcaaaaaaaatctattctgaggttttagttaaacagagaaataatattaatgctttagttggtcttgcttcgatttttgaacaaaatggcttatttatagctgccgctaattattatttatctattcttgattatagtcaaaataattatagtgcgtttgaacatcttattgatatttatcaaagactaggaatgcatgacaagattagacatttgataaataaagtcagagtaaattttttatcttttccagattttcataaaagagtagctgaattttatattagcattaataatttagggcttgccgaaaagtatgctttaaattatttagctttaattgaaagttcttataaagattttggagttgttggtgcatatcgattacttgcgcttgtttatcttcatgaatttaaatatgaggatgcaatagaatcattacagaaagctattttggttaataaagactctgatgaactttattacttattgggatattcttacttaaaatttgggaatattgaaaaggctattttaaatttagaacgagctaaaaatcttaaaaaagatttagaattttatagtattgctcttgaggagagtttttttgcatcgaattttagaaattttttgaaaaacaattccaatgctaaaatttctaagcattatgaaaatgaaggatttaaagcttttaaatctttggatttaaacaaagcattgtttaatgcaaaaaattctattgatatttggcctgataatgacagcgccaggtttttgctttcaaaaatttataagcttatgaatttagatattatgtcttatgagcagcttttttatttagttaaacagagaaattccactgattctagaattttggatttttatgatgttgtgtcttttgatgttagaaagtctttattttataaatatggatataaaagcattgctgattttaataaactttacgatgacagaacggtttatagaatggctatttttactcaaagtgaaaataaattttttggggcaaacgatttgatattaagatacgctgaaagggtgcttgagcgtaatttgaatatagaaatagttaactataattttgattacaataaaaatagagactatttgattaataatttttccgaaggattttcttattcaaggaataataatttggatttatttttaatttttgattttaaggcagatattttgaaaaatacagctactttattagttaatgttttttcgggaaaaacaggaattaaggttagttctttctcttatgatgtggggggtgttaattatttaagcaatgctttaaattccttttctaaagattttcatgattatttgcccaaaaaggggaagatccttcaaattaaaaatgaggatgctcttattaatcttggtcaagtaaacggtgttttaaagggtgatatttttttgattcttaaagaaggcgctttaaacggtgaaactagagattctaattttattgtttataaaagatcagatattttgggggagattttaattgaggatacaagtgattatatttccagaggtactataaaatcttccacctttttaaaggattatattcaagagggagccactgtgcttgtaaaaaga

SEQ ID NO: 508 - DNA, 714 bp, Borrelia garinii
atgaatctaatgttaataacttttaatgaatttaaaacaggaatttcactaaatgacaccagggcagagcatcttgttaaaatcttaaaattaaaagataacgacaaatttaaatttggcattcttggagaaagaaacatttaccattgcatttacaaaaaagataaaaaactatttttcaagaaaatctttaaaatagaagaatctaataaactcaaaaaattaaatgtactaattgggatgataagaccacttgtcgccagaagaatcataaaagaacttgctagtattggaatatacgaaataattttttttaacactgagcttactcaaaagtcgtatttaaattctaaaatctttaaaaataatgattacgaaaaacatttaatagccggagcaatgcaaggaggaacaacatatttgccaaaaataaaaattatgaaaaatttaaaggaaagccttaaatatattgaacaagaaaattttgaaataaaaatattgcttgaaaaagatagtaaaaaaaaattaattgatatagagcaaataaacaacgcaaccattattgtgggacccgagaggggatttacagaaaaagagaaacaattaataacgcaatataatttttccccttgcagcatatcatcaaacatcctaagaacagaaacagccatcattgctgcatctattattactgcatcaaaactaattaatgtg

SEQ ID NO: 509 - DNA, 945 bp, Borrelia garinii
atgaaaatattttttgtaagttcttcttttattgctttagaagtttttaaggagattttaaggcattatgaagtggtgggggttttaaccctgcctgataaacctaaaggcagaggacaaaagttaagtcaaaatgtaataaaggtggaggctattgctaaagatatcaaggtttttgatcccttgattcttgataacaatacattaaattcaattagagatttgaatccggatttaatgttggttttttcttatggcaagatatttaaaaaagaatttttagatatttttcgaatgggatgtattaatgttcatccttctcttttgcctaaatatagaggtgtttctcctattcaatctgcaattttaaatggtgattgtgttagcggtattactattcagagtatggctttagaaatggatagtggcaatattttggtgcaaaaaaaatttaaaataagatcttatgatacaagttatgatatttcaaagcttgtatcaagtcttagtccaagccttgttttagaagctttggaaaaaattagtaaggggtttttaggaattcctcaaaaatcgagcgaagctaccttttgttcttttttgaaaaaagaattgggctttatagactttaatttaagttcatttgaaattaaaaacagaattaatgcatgcaatccttggccgcttgtaagggctaagcttgattatagtgacattatttttcatcgtgctgatttttgggaaatagatttatataaagagagaaaagtaggagaaattgttgattttgatcccgaaagaggattatttgttaatactggtaaaggaattcttttcctcttagaagttcaaagacccggaagaagggttttagattttaagtctttttataatgggagtaggcagctaataggacgagtgttttcttcagtaggaggaatatat

SEQ ID NO: 510 - DNA, 1050 bp, Borrelia garinii
ttgaacaagccgaaggcatttggaggaagctttgacaaaaaagaaattcaagataaaatagaaaaatacgaaaaagaaatacaccagaaaaatttttggaatgatcctaaaagagcccaagaagttataaaagctcaaagtatcttgaaaaataaaattgatccgtgggaagagctaataaacaaaatcaaagatttaagcgatctttgtgaaattgttgaaaatgaaaaagatattaacagcttagaaatcgaatttaatgtacttgaaaaacagtacaaaaatttactcacaatttcttactttaaagaagagcttgacataaacagcgcttttttaactattcattctggtgctggaggcactgaagcatgtgactgggttgcaatgctttacagaatgtactcaagatatgctgagagaaaaaaatataaaacagaactgattgatttgcttgaagcagaaggtggaattaaatctattacaatagaaatcaaaggtgaatatgcttatggacttttaaaaagtgaagttggaatacatcgccttataagaatttctccgtttgatgctgctaaaaaaagacatacctcttttgcatcagtatttgttgaccctgttattgatgagaaaatagaaataataattaaaccagaagatataagaattgatacatatagagcatcgggagctggggggcaacacgtcaacaaaacatcctctgctgtaagaataactcacattgaaacaggaatagtaactcaatctcaaagcgaccgaagtcagcacaaaaacaaagatatggcaatgaaagttttaaaatcaagactttacgaatactataagaataaagaagataaaaaaaataaatccaagcaagaagtaaaaaaagaaatttcttggggcaaccaaataagatcttacgtatttcaaccttacaatttagtaaaagatcacagaacaaaatttgaaaattcaaacaccacttcggttatggacggcaatatagataatttcatagaagagtatttaaaatggaaaagtttaaac

SEQ ID NO: 511 - DNA, 1026 bp, Borrelia garinii
atgaaaaaaaaacaattaatacttcttctatttataacacaaattatttatgcaaaaagctattttgcatctgacacatttttcaataaataccaaaaattaaacgaaaaaccaaaaaaaggattttacattgagtatcatttgattgatgataccgaaaaactctacttatataaagaaacaaatttaataaaatataagacaattcaaataatagaaaacacaagaaaaatcacatattatgatacaaaagatacaaaaagaaaagaagaggtttacgataatttaaataataaaatacaagaaattgaatatgacagcaaaggaaaaattcttgaaacagcaaattacttttatgaaaacggcaacttaatatccaagaatttaaaaacaataaaccaaaaaccaaaattaatattttactctaaagatgaaaatggtaaattactaaaaataacaggatcaaatttccaaatttggaactatggaatcaatggcgatataaaatctacatattttgacatcaaaaaatcaacaacaaaggctataaaatatgatgacaaaaaaagaaatttaaacagtacaattattgttaataataaaataaaatctaaagaaaaaaaccaatatctagatgaacaaaaaatagtaaataccgttgaagaagcaaacacaaaaatcatatctacatatcaaagaaacaatctaattaaagaagaaacatataaaaataatgaacttataaaaataaatgattttcaatacaactcatctgatatgataatttttcaaaacactaaagaaaaggataaagaccaatataccaatactaaaattgaatacgaatataacaaagacaaccaattaaaaagcaaaaaaatttatgaaaacgatataatttatctaaaaaccgaataccacaatgataatgaatatgaagaagaaatatactacaataaaaaacccgctcttagagtaaagcataagaatggaaaaatcatcgaagaaaaaccaataggaacaaat

SEQ ID NO: 512 - DNA, 1251 bp, Borrelia garinii
atgatgcttctaaagctaacagaaattacaaaaattgcgtatataatttttaaaaattcaacaaataaaatagctttaataggttctggaatatcattaagtttagtaatgatcccactaattattgtctactatatgtctagcaatattatgacttctactattaataaatatattgaaagtgaaggtttttccattcaaatagaatacaataacacaaataaaaccaattacttaaaagacagattaagctcatttaaaaaaaaatataattacaaagatttaaattacttttttgagaaaagaacttacggaattattggaaataataaaaaacaaggcgtattaataagagcaatagaaaatgaattcatattggaaaacaaatcaataaaattaataaaaggtactaaaaatttaaaaaaggactccatactcattccaaatcaaataaaaaataaacttaatttaaatctcaatgaaaaaattgatattttgattccaaatgcaaaaaaccataaaatactgcccagaataaaaaagtttcatatctcaggaataattgaaaccggactaaaagatattgacaataacttagttttaatttctcttgaaaacgaaaatttaatgtcaaaaaagttttcaaaaagcataattggaattgaaacaaatttcaattcaataaaaaacaatgaaatcttgaaacagaatttagaaactgaatttcaagaattccaaataaaaacattttatgaactttacttaaataaatacaataatctagatataagtaaaaaacttttaatattcattatggctttgattataatatttgcaagcattaatatatcttcgtctatttcaatgcttatttttgaaaataaaaagaaaattgcaatactaaaatcaattggaatgaataatttaaacataaaaataatatttcttttgatatcgctcacattaagcactaccttttgcgggattggaataataattgggaactatttaacacttaaaatatcttatttaataaactttgttgataatgttttaaacttttttttaaaaatatttggagaagaaaattctgaaatattaaactcagaatattacgtatctgaatttcaaatagacttaagcctgagctttagcttaacacttcttagcttatatatgttaataaacattttaactacactggttccgctcaacattgtctcaaatctaaaagaaaaagaaatcttaaga

SEQ ID NO: 513 - DNA, 432 bp, Borrelia garinii
atggatataggtttaataggagttaattcagctttgacaatttcagcaataggttctgcgttgggtatgggagcagcaggtagtgctgctattggagcatggaagagatgttatatgcaaggaaagccagcaccatttttattgattgtttttgtttcagcaccattgactcaaataatatatggatatattttaatgaacactttatatgaggtgatgatgcagacaaatccatggttgttacttggagctggtattggtggtggttttgcgattgctgtttctggatttgctcaaggtaaagcggcagcaggcgcttgtgatgctttttctgagaccggaaaagggtttgctacatacctattagttttaggattaatagaatctgttgctctttttgtaatggtatttttaatgatatttaagtttgtt

SEQ ID NO: 514 - DNA, 1725 bp, Borrelia garinii
atgaagacaaaaggaaaagtcgttggagtgaatggtaacttagttactattgaggtggaaggttcagtttctatgaatgaagttttatttataaaaactgctggtagaaatttaaaagcagaaataattcgcgttaggggcaatgaagttgatgcacaagtttttgaattgacaaaagggatatctgttggagatgtagttgaatttacagacaagcttttaacagttgaattgggaccaggtcttttaacccaagtgtatgatgggcttcaaaatcctttgcctgaactggctattcaatgtggattttttttagaaaggggagtttatttaagacccttgaataaagataagaaatggaattttaaaaaaactgctaaagttggagatagtgttattgcaggagattttttaggctttgtaattgaaggaactgtccaccatcaaataatgattccattttataaaagagattcttataaaattgtagagattgtaaatgatggaaactattcgattgatgagcaaattgctgtaattgaagatgattctggcatgaagcatagtattacaatgtcttttcattggcctgttaaaattcctattactaattataaggaacgacttattcctagcgagcctatgttgactcaaactagaattatagatacattttttccagttgccaaaggaggaactttttgtattccaggtccttttggagctggaaaaacagttcttcagcaagttacaagtcgaaatgctgatgttgatatagtgattattgcagcttgtggtgaacgagcaggagaggtggtagaaactcttaaggagttccctgagttgatagatccaaaaactggtaaatctttgatggatagaacttgtattatttgtaatacaagttctatgccagttgcagctagagaagcctctgtttataccgctattactattggtgaatattataggcagatgggtcttgatattcttcttttagcagattcaacttcaagatgggctcaggctatgagagaaatgtctggtcgccttgaagaaattcctggcgaggaggcttttccagcttatcttgagtctgttattgcttccttttatgaaagggcaggcattgtagttcttaataatggcgatattggatctgtaacagttggtggttctgtaagtcctgctggtggtaattttgaagagccagttactcaagcaaccttgaaggttgtaggagcattccatggacttacaagagaaaggtctgatgctaggaaatttccagctattagccctcttgaatcttggagtaaatataaaggtgttattgattctaaaaaggcagaatatgcaagatcttttttagtaaaaggtaacgaaattaatcaaatgatgaaagttgttggggaagagggtataagtagtgaagattttttaatttatttaaaatctgaactgcttgattcgtgttatttgcaacaaaattcatttgattctgttgatgctgctgttagttcagagcgtcaaaattatatgtttgatatagtttataacattcttaaaaccaactttgagttttctgataagcttcaagcaagagattttatgaatgaattaaggcaaaatcttttagacatgaatctttcttcttttaaagattataaatttaataaattggagcaggctttgagtgaattagtaaatttaaaaaaggtaatt

SEQ ID NO: 515 - DNA, 1191 bp, Borrelia garinii
atgaaaaaggtagctattattgatggacttagaatgcccaataccaagtttggaggttcttttaagggcttggatattattgatgaatcttcaaaagttgttaaagctttacttaaaagaaataatttatgcgaagtggatgaggtcattgttgggaatgtaatatcttcaggacttggccaaaatattgcaaggcaaattgctttaaagtctagtttgggcgataatgtgcctgcatttagcgtcaataaagtttgtggctctggtcttaaagctttggagcttgcatttaattctattgttcttggaaacaatgatattgttttagctggagggatggaagatctaaccaattctccttatttattgcccagaaaggttagatttgacggtcttaaatttggtaattttggaattgaagattcaattcaaaaagatgccttaatagattctctaaattttatttctatgggacttacggcggaaaatctttcagaaaaatataaaataacaagagagatgcaagatgaatttgcatataattctcatgtaaaggcattaaaggcaagagaacttggatattttgaagatgaaattcatcctttgactattcttgataagaagactaattctagtaggattgtctcaagtgatgaggaaataagagataatttaactctaaataagctagcatctcttaatcctgtttttaaagaatcaggcacagtaactgccggaaattcttctagtttaaatgatggggcttgttttttaattttagcaagtgaggaaagagtaaaaagcttaggggtaatgccattggcttatattggggggtttgaaagcgtagggcttagtccgctttatatgggttttggagcttatatggccattgaaggcattattagtaaattaagtttaaaccctagcgaaatagacttgattgaggtgaatgaagcatttgcagctcaagcattaagcattgaaaaggccttgtttaaaaaatacaatatagctagcgatattatcaatgtaaatggtggtgctattgctttggggcatccatttgcggttagtggttcaagaattttattaacacttgctcgttctatgaaaatgaagaataaaacaaaaggaatagcatctgtttgtgttggcggtggacaaggaatttctagttttttgtataga

SEQ ID NO: 516 - DNA, 1653 bp, Borrelia garinii
atggaaaatcaaaaagatttacaagaaaattatttgaaagtacttgaaagagtagaacttggaagtcgtgtttctggaacggttattaacattatgaaggattatgttctagtagatattggttataaatcggaaggctttattaaaattgaagaatttgaaaatgtgcccaagattggcgataaacttgaggcaatcgttgtaagaataggcggagaattgggcctgattttaagtgttgaaaagcttgattctttaaattttcaagataaagtagatgaatatattcaaaataaaaaagtaataaaaggtaaagttttggctgagcttgcaaatggctataagattcaaattaatgaaaatgtttctggctttatgcctttttatttaagctccaaatctaaggatgaaaaattaaaaagaggtcttattgttgaattttatattcttgaagcaagcgaatcggacggcttgagacttattcttgatagacgcactttagaaagagaaagagatcttgccaagagaatagagttagtaagttcttataatgaagaagatgtggttgatggtgtggttgatcgcattacagaatatggtgcaattgtaaaaattaaaaattttgttacaggaattttgcacaaaagaaatattgcctttaatcaagttgaaaatattgaagattttgttagagttggcgataaattaaagttgaaaattattaagataaatctgcaaacaggtaaaatggaactatctcttaaggccctaaaagcaaatccttgggattctgtagatattaaatataaaattgatagcattgtaaaagggaaggttgtaaaaattttaccctttggagctgttattgagcttgatagcgaattgtcagggtttttgcatataagtaatttttcttggataagagtaataaagagtcctcaagaattaataaaacttggccagatggtagaagttaagattttagaggtagataaagaaaatcaaaaaatatcgttgggtatcaagcagatcaatgagaatccttgggagaggttaactgagaaatatcctattggaaaggttattcaaggggttgttactaatattacaaaaacaggtgcttttgtaaatattgaagaaggtatagatgcttatgtgagtaagtttgatatttcttggctcgaagagattgatcctgaagaatatttcaagataggcgatttagtgaatggcaaagtgcttgaagttgacagacgaaagaggaatgttagactaggaattaagcagctagaagagagcccttgggaagatttttctaaaagttataaaaaaggtgatgctattgaggttgagattgtagagaaaaagtcaaaaggctttcaagttagagtttataataaaataatgggatttattagtaaaattcagctaggagatacaaaagaatccagtttggaaacttttgaaaaattaaacattggagataagcttaaagtggtaataacaagtattgattctaaagacagatcagtacttctttcttatagggagtatgaaaatcaaaaatcaagagaagagatttcttcttatttatttaagggcaacgatgaggaatcttataagccatttgaaagtttgttaaagagggatgaa

SEQ ID NO: 517 - DNA, 1887 bp, Borrelia garinii
atgaccaaaaaaatacttaacaacaaatatcgaataaagacaatattaataatatctttgggtataactttgctaactatttacaaatattttacattaatggtcttaaataacagcccagacaacattatatctttaaagtcaaatgatattgtaagaagaggaacaatttatgatagaaatggcaaaccaatagcattctcttcaaagtcctactcaattggaacaaaccctcaaaaaatagaaaatattgtaaatacatctgaaactcttggcgcaatactccaaattgattcaagaattttaaaggaaaagctttcttccaataaagggtttttatatataaaaagaaaaataaaaagagaagagtcagatttaatcaaaagaattcaagctgaaggcaggctctcaaacattgctttatatcctgattacacaagaatttatccttttagacatgtcacaagcaatattactggatttgtgggaacagataatcttggccttgagggcattgaattttctctaaatagtatcttagtgaaagataaaaccaagcaacaatttttaaatgaagaattagaaacaaacaacatctacttaacaatagacatgaatatacaacaaggtgttagcaaaatagctaaaaaatactttaaagaaaataatcctgaaagtttaattactttagtaatggactcccaaaatggagaaatattatctatggttcaattccctcaatatgatgcaaacttttattctgaatatcctgaagaaatacgaaaaaacctttcttcatcattaacctatgagcctggaagcattaataaaatttttacagttgcaataatattagaaagtggaaaattaaatttagaagaaaaatttttagacaatggaatatatcaaaaacaatttccatcaggagagaaaattacaatcaaaaccttaaatcctccctataaatacatcgactctacagagattttaatttattcatcaaatgtaggaatagcttacattactgacaaagttagcaatgaatacttttacaaaaaacttttagattttggatttggaaaaaaagttggatttccatttcccggggaaacaaaagggctcttaaatcattattcaaaatggtcaggaagaagtaaagctacgattggatttggacaagaaataggagtgtcagcagttcaaatattacaagctgcaagcatactaggcaacaatggaataatgttgaaacctagaataataaaaaaaataagtaacgataaagaagaaagtattaaagagtttgataaagaagaaataaaaagagcaatatccaagagttcagcacaaaaagttttaaaaatgatgagagaagttgtaaataaaggtggaattccaaaccttaaaattaaaaatcttgacatttctgcaaaaagcgggacatctcaggccattgatagaaaaaccggaaaatactcagaagaagactatacatcctccatcttagcaatataccccacagaacaaccaaaatatattatttatattgtatacagatatccaaaaaaaataatatatggaacaagaatagcagctccaatggcaaaagaaataatagaatttattgaatatcaacaaaacacaagcgcatataaaaaaatcaaaatgccatcaaaaatcaagattcctaaaactgccgccaattataaaaacaaggcatacttgccaaattttataaatctttccaaaagagaagcaatagacatactaaaatactataaaaacaccataaaaatcaaaataaatggcgctggatttgtctataagcaaagcatacctcccaatacaaaattagaagacatagtagagcttgaactgtatttaaaa

SEQ ID NO: 518 - DNA, 1008 bp, Borrelia garinii
atgattataaatcataatacatcagctattaatgcttcaagaaataatagtattaatgctgctaatcttagtaaaactcaagagaagctttctagtggttacagaattaatagagcttctgatgatgctgctggtatgggggtttctgggaagattaatgctcaaataagaggtttatcacaagcttctagaaacacttcaaaagctattaattttattcagacaacagagggaaatttgaatgaagtagaaaaagttttagtaagaatgaaagaattagcagttcaatcaggtaacggtacatattcagacgcagacagaggttctatacaaattgaaatagagcaacttacagacgaaattaatagaattgctgatcaagctcaatataaccaaatgcacatgttatcaaacaaatctgcttcccagaatgtaagaacagctgaagaacttggaatgcaacctgcaaaaatcaacacaccagcgtcactttcaggatctcaagcttcttggaccttaagagttcatgtaggagcaaatcaagatgaagcgattgctgtaaatatttatgctgctaatgttgcaaatctattctctggcgaaggatctcaggctgctcagactgcacctgttcaagaaggtgctcaacaagaaggagctcaacagccagcacctgctacagcgccttctcagggtggagttaattctcctgttaatgttacaactacagttgacgctaatacatctcttgctaaaatagaaaatgctattagaatgataagtgatcaaagagcaaatttaggtgctttccaaaatagacttgagtctataaaggatagtactgagtatgctattgaaaacctaaaagcatcttatgctcaaataaaagatgctacaatgacagatgaggttgtagcatctacaactaatagtattttgacacaatctgcaatggcaatgattgcgcaagctaatcaagttccccaatatgttttgtcattacttaga

SEQ ID NO: 519 - DNA, 1995 bp, Borrelia garinii
atggcatcaggattttttgttcctggacttgagagtaaatataatactaaagaaattcgtgaatctatgcttaagcccgatagagctaaaattgattcttcttttaagaaacttgaatctttagaacaagaaaaaagcgcttggcagttaattaatagaaaaatctctgctttaaattctcttgcaaaagaaattacgtcacttaacagtccttttaatctaatgtcagggaattctagtaatagcgaagttttaaccttgtctactcggtatggatccaagaatgagactcataaattaattgttgatcaaatagcgtcagctgatgtgtttttatcttcaaattttgatcctaaaaaagttacaatcccagaaggagattatatatttttagttgggaagaaggaaattaatgtaaaaagtaatggcaacattgatttgcttgttaaggatattaataacaagggaaagggctttttatctgcaaaaatagtaaaaagtgataaaaatgggaatagtcgttttattttgcagtccttaaaggaaggcaaagagaataaacttgttatcaaaggggaaggattgtcttttgctaagcaaattggcattttaagtgaacttaaaactaattttaatcctaccttttcagatattgttgtaaatcaatctagtagtaataatagacttgtttttgaaaacaatagccttgttttaaatccgctttcagaggtgtcgattgaaattcctgaagatattgaaattacatctaggagtaaaattaaatttaaagtcaagtattttgatacaggtttagaagagcctgacagtaagattatttttaatcccggagaagctacatttaaggatgcaaaagttgacagtgaatatagtgtagttgatcttggatctgatttaaaaactcctttggaaaaaaaatatattcaaatgaatatggttaaaatatgcaatatagagggttctctagagcttccttcaataaatatttcaaataactttgaagaagttgaagctgatgttggagctttttctaatttacaagaaataaatattgaaattacagcaaataataaagtaattgtgattagcaatgtcgaagtttttgatcccaaaaatagagatggccatttaccaataaatgctaaaagttttgccgagaatgcaaaaattatatttgatggagtacatgttgagagagatttaaatgttattaatgatttaattccaaatgtgacattaagtttaaaaaaagcttcaagtgatatggttgaggctaaagttgaacctgattacgagggaattaagagagtccttttagattttattggtgcttataatgaggttattgctgagattaatattgtaagttccaatgaagatcaacttggaaatcaaaagtccaatatagttgaagagctgacttatcttagtgaatctcaaaaagaagaggcttataaaaatttaggtgttctaaggtctgaatttttattgaaaaatcttaaatctagactagaatcaataatttttaagccttatgttactagtgatcctaatttttcaataattaatcagatgggagtgtttaccaactctatttcttcttctgggggactttccagatatttgagacttgatgagaaaaagtttgatgaatcgattcgcaacaacattgataatgttagagaactttttttatttgaccttaatggcgacagagtctatgataatgggattgccaaaatgctaggagattgtttagcgcctcttgtgacttctggaggagttatttataataaaataaaaaattacgatcttaaaattgttaatcaaaaaaataaagttgaagattataaaaaaaagtacgatgatagagagagaaaagtagaaggcgagcttaatatcttagattttaccgttaagcgaatgaaagatcaggaaaatacattaaaggcttttgattttaatcaaagaaataga

SEQ ID NO: 520 - DNA, 1203 bp, Borrelia garinii
atgccaaatttttgcttattcaactcaaaatccgttttaactggaaacgacaaactagataattcagcggtccttattaaagataatgaaatttttgatattgtaacatctgatagacttaaaaaaatggatctcagggaatatcaaatgattgatgcaaaatgcaactatataactcctggactttacgacagccatattcatggatttcacggttatgggacagaccagtgctcaacagaatcaatacttaaaatgtcagagcatttggcacaatacggtgtcgtaggatttttaccaactctttatccaagaccaatagatgaaatgattcaaacaataaaagcttgtacagcagcaattggcaaggaaaagggtgctaaaattttaggacttcaccttgaagggccatttttctcccctgaaaaaagaggcgcacaccctgtttcttatcttcacgaaccgagcattaaagttatgcaaaaactaatagatgcagctggtggaatatttacaggatcaaacggccaaaaaaaaacacatataagcacaatgactgttgctcccgagcttaaaggaatgagagaacttgcaatgttttgccttgaaaacaatataaaccttcaagcaggacacacaaacgcaacatatgaaaatatgatcgaaggatttcaagttggaatacttcatacgacccattttttcaacgcaatgtcaaaacttgaccacagaaatccaaatgcaataggagcagtattaatacatggtgatgtttcttgtgaaattattgcagatggtcatcatatacacccaaaattagttttaatgatgagaaagcttaaagatataagtaaaatagtccttgtaactgacggacttactccaaattttcaaacttctggaaaactaattgcaaacggagatgaagtttatattgcagaggatggcttattccacagtgtgaaaagcaacacaatagctggatcaacgcttacaatgatacaaggtcttaaaaatttagtagaattcggctacagtttaagtgatgctgttcaagcaagctcttacaatccaacaagaattcttaatattgataaaaagggattaatatgccatggatatgatgcaaacatcaatgtcttagataaagatttcaatttaaaattaacaatgatagaatctaaaataatttttaacaatctc

SEQ ID NO: 521 - DNA, 1881 bp, Borrelia garinii
gtggattcaacattctcaggaatagaaattggcaaaagaagtttatttgcacataaagatgctatgaatacagttggtcataatttatctaatgctacaaaacctggatattcaaggcaaagagtaacaatgaaaaccgaaattcctctttatgctccgcaactaaacagagctaaaaagcaaggacaattgggtcagggaatagtggttcaatctatagacagagtaaaagatgaactgcttaatacaagaatcgttgaagaatcacaccgactagggtactggacttcgcaagacaaatttatatcaatgttagaagatgtttataatgagcctgaagatcaatcaataagaaaaagattaaatgatttttgggaaagttggcaagatctagcaaatcaaccacaaggtttagcagaaagaaaaataattctagaaagaggcaagtctttttgcgaattaataagaagtagattccattcactagaaagaatttacataatggcaaacgatgaaataaaaattacaacagatgaggcaaacaattacattaaaaacattgcaaatcttaataaacaaatttcaaaatctcaagcaatgaaagacaatccaaatgacttaatggatgcaagagatttaatggttgaaaaattgggcaatttaataagtgtatcaattgaaaacaaacaggatcccaatgaatttttaattcactcagaaggaagacaccttgtgcaaggttcaattgctaatgagtttaaactagaagctacaaacggacctaccagaaccaaatggaacattttttgggcaaataatgataaagctaaccttgaaacgggaaagcttggatctttgcttaacataagagatgaagagattaaaaatgaaatcaatgaactaaataatttagctgccaacattatagagcttgttaacgaaatacatgaaacaggacatgggatggacaaaaaaagtggaagaagctttttttctcaagagctaaaactaactgatgagcgcggtcgatatgatactaacggaaatggccaatttgactccgttcatattttcaaaattaatagcacaaatgaaatattcccagaagagaaattaggattttatggaattcttaaatttgaggctactaatagcaatgagattatagaaataccttacaatgctccagatacagttcaagatctgataactagaataaacaattcaaatgcacaagttacagcaagaattaactcagaaggtaagtttgaaatcaaagcagttaaagaacaagaaaatgaaaacataacatttagaattaaacatatagaagattctggattatttcttacaaaatatacaggaatattaaatgaatctggacctgagggagcttatgattatagaaatattgacacaatagacaaattaacccctaagtccacttattcaatctcgcctctaaaaaatcctgcggcatggataaaagttgcagacataatagacttagatccttcaaaaatagcagcgggaattaatagcccaacaaatgaaatatctattggagataaccaagcagcattgagaatctcctcttttggaaattctcagattatgattggtaaaaatttaacactaaatgattactttgcaaatacagcatcaaatatagcaataaaaggacaaatatcagaaatcacaaaagaaagccaatctcaaatattaaaagatttaacagatctaagaatgtctatttctggagtaaataaagatgaagaacttgcaaacatgatcgaatttcaacaagcctttattgcagcaagtaaatttatcactgtttctgccgaactaatagacacaataataaataaaatgggagta

SEQ ID NO: 522 - DNA, 738 bp, Borrelia garinii
atgtctagcccaaaaatacttaccataatagtgctcttggcaattttagcacaaggatgcaaagaaccttccattattgaaaaacaatttaattatacaatagttttttcagatgcaaccgaatatttttttcaaattcaaaaaactccattcataaaaaacaaaatactatttataaatgacaaaagtttagaaattataaaagataagcttaaaacaataaaaaaaatactattaacccataaatccaataatgaaatattaaataacgaaattttaaaagagaaaatttttaatctatcaaaaataaaattttctctaaaaaagtctattgattttctgcttaacggaaaatcaatagacttccaaaaaacattattatttagagataaatctctaaataacgaagaccttgaatacttagaaaaaaaaggtaaagaaaaaaacgttaatattaccctaataaacgagaaaaacatatcctatataaaaacatttattactccccaaataaaaacaataatattattttcttttagagataataatattattttaaaaaagatatcaaattcgccttttttcaaaaatatacaatttgtattaattggcaatacaagaaaagacttaaaaattattaagttaaaatatgtaatcactcttaaagaatctgatttgatggaaatagtaaaagacattgaaacagattttcaatatgaatttaacatctataaacaa

SEQ ID NO: 523 - DNA, 1083 bp, Borrelia garinii
gtgaaaaaaaatcttatgttaatatttggtggagtttcttttgaacatgaaatttcttgcaaatctgcttatagcatttatttagcccttttggatctaaataaatacaatatttatcctgtttatattgataagtgtacaggtatttggtatttattagattctgtttcagatcctccaaagcttatcgatatagatgttttacctattgtaagcttattgcctggtattggaattttttcaaataacaaaaatcttgatattgatgttgtttttcctgttgttcatggaagaaccggtgaggatggtgctattcaaggggttttaaaagttatggacattccttgtattggtgctggcattatagggagcgctatttctagcaataagtatttttgcaaacttttgcttaaaagttttaatatccctttagtgccttttattggatttaggcaatatgattattttttagataaagaggaggtaaaaagaaatgtaagggaggctttaggctatcctgttattgttaagcctgcagtattagggtcttcaattggaataaatgtagcttacagtgaaaatcagattgaattttttattgaggaagctttaaagtatgaccttactattttaatagagaaatttattgaagctagagagatcgaatgttctattattgggaatgaaaagataaaaatattttctcctggggaagttattgttcaagattttatattttatgactatgatgctaaatattctgttattcctggaaattctattatttttaatattcctgcacagcttgagacaaatcagttgttaagcattaaggaatatgcttttcttgtttataagaatttagaactcaggggtatggcaagagttgatttttttgttgaaaaaaaatcaggaaaaatttatcttaatgaaataaatactattccgggatttaccgatatatctatgtttgctaaaatgtgtagtcatgatggtcttcagtttaaagacttggtggataatttaattaattatgcttttcaaagttacattaatagaaaaaaaagaattaattttgaagat

SEQ ID NO: 524 - DNA, 2718 bp, Borrelia garinii
atgaataaaaaacgtacaaatttttcggtattattgcttttaattttcttacttattttatcatttggaggctttggttactatatatatcaaagcaaattaaatgacaaaaatcgagaaataatgctaaacgaagttaaaaatagcataatagatcgaaactataaaaaagcatattctgttgcaaaacttctgcaagacaaatatccaaaaaatgaagacattgcaatgcttacaaacacactagcagaaattgccaacagcagtccttttgaatcaaacgaattacaaagagattctgcaaatcaaatcctcgataagattaaaggtcaagaaaatgcaaaaacaaatataaacgaaaattttgatatcgcatttaataatagatatattaaagacagcgcaataacagaaaactacgctgacagaaacgatgacattggcattgaagatgaagacatatctgaatttaaaaaaagcaaaatcccagaaaaagtaaaccaaaatgcaaaacaaaaagaagaagatcaggcaatacaatctccaaatcccaaattaaacgttaatgatcaaaaaaattcatttaatttggaaaaactaaaaaaaaaattaagcgaaaaatcaaatagtgaaaatattttaaaaaaccctcaaaatatagaaaatgataagcaaagctcaaatttctccaaagaaaaaaattcagagcatattttaagaaacccagacaatagtaaatattcaaaaaatgataatgccacatttttaaaagatgttcctttaaattctaaaaaagaaagtgatttttctctgcccagtcaaacaataataggaaaaattcatagaccatatagctacttaataaaaaaagagctctatgaaatattagacgatattaataccggtagagtcgcacttggaaaaaacagattaaaaaaattaattaaaaaagggttaagcaataaatttcaaaaagtaaatgagctgattgaaagtttaaagaataaagacgcctccaatttactattaaccttaataaaaaaagatattgagccaaatttaatcaatgtaccaaatataccaaaagatccttacaaaaaagacatttttcaattaaataaagaagacaagaaaacccaacaatcggaagaccttaaatctaagatctattcaataaaacctactgatcttgaaaacccaaaaaacaggcaacaagccattaaagatctaaacgaattcttaaaaataaatcctaatgacacttatgcctctaaaactttggctcaagctaataaaatacagcaatcagaaaaccttaaatctaagatctattcaataaaacctactgatcttgaaaacccaaaaaacaggcaacaagccattaaagatctaaacgaattcttgaaaataaatcctaatgacacttacgcctctaaaactttggctcaagctaataaaatacagcaatcagaaaaccttaaatctaagatctattcaataaaacctactgatcttgaaaacccaaaaaacaggcaacaagccattaaagatctaaacgaattcttgaaaataaatcctaatgacacttacgcctataaaactttggctcaaacttatgaaaacaatggagatttactaaaagcagaaaatgtatatgaaaaaattgctaagctcacaaatgcccaagaagattactataaacttggaatcattagattcaagctcaaaaaatatgaacactcaatagggtcatttgatcaaacaataaggctcgacccaaagcataaaaaagcacataataacaaaggaatagctttaatgatgctaaataaaaacaaaaaagcagtagaatcttttgagaaagcaatacaaattgataaaaattatgatactgcctactaccaaaaaggaatagcagaagaaaaaaatggcgacatgcaacaagcatttacaagttttaaaaatgcctacaatatcgacaaaaaactcaattacgcattaaaagctggaatagtatcaaacaacttaggcaacttcaaaaaaagtgaagagtatttaagtttttttaatgacaatgcaaaaaaacctaacgaaattgctatttacaacctatcaatagcaaaatttgaaaacaataaacttgaagaatctcttgaaataataaacaaggccctcaatttaaatccagaaaaaagcgaatatttatatttaaaagcatctataaatcttaaaaacgaaaattaccaaaatgctatatcactttacagctcagtaattgaaaaaaaccctgaaaatacttcagcctacataaacctagcaaaagcatatgaaaaattggggaataaggctcaagcaatctcaactcttgaaaagataataaacaaaaacaataaattggccttaaacaatcttggaatactttacaaaaaacaaaaaaattatcaaaaagcaattgaaatttttgaaaaagcaataaaaaattcagatattgaagcaaaatataatcttgcaaccactctaattgaaattaatgataacataagagctaaagaccttctaaaggaatatacaaaattaaaaccaaacaatccagaagccttacatgcactaggaataatagaatataatgaaaataataatgatcaaatattaagagaacttgtcaaaaaatttccaaattacaaaaaaaatgaaaatattagaaaaataataggaata

SEQ ID NO: 525 - DNA, 834 bp, Borrelia garinii
atgaaaaaatttgttatcttaatttttatgttatcagtaagtttattatgcaactgtaaaaatcaagacaatgaaaaaattgtatcaattgggggatctacaactgtaagtccgatactagacgaaatgattttaaaatataataaaataaataatactaaagtaacatacgatgcacaaggaagtagtgttggcataaatgggctatttaacaaaatatataaaatagcaatatcatcaagggatttaacaaaagaggaaattgaacaaggagcaaaagaaactgtatttgcttatgatgctttaatttttatcacaagccctgaaataaaaattacaaacattacagaagaaaatctagctaaaatactaaatggaaaaattcaaaattggaaacaagtgggaggccctgatgctaaaatcaactttattaatcgagactcttcctctggttcttattcgtctataaaagatctacttcttaataaaatatttaaaactcacgaagaatctcaatttagacaagacggaatagtggtaaaatctaatggagaagtaattgaaaaaacaagccttactccatactcaatagggtatataggtcttggatatgcgaaaaattcaatagaaaagggcttaaatatactttctgtcaacagcacataccctacaaaagaaacaataaataataataaatacaccattaaaaggaatttaataatagttacaaataacaaatacgaggataaaagcataactcaatttattgattttatgacaagctcaaccggacaagatatcgttgaagaacaaggttttttagggataaaaaca

SEQ ID NO: 526 - DNA, 1215 bp, Borrelia garinii
atgcaggatcctaggctgtccaagtataaaaatactaaaaatttaagtaaaaaaactgttgaagaaattgatactttgagtttaaataaaaacttttccgattcagagattcaaggttctatgcttagatcttggataagtcttattaagggtaataaaaataaagcacctgttgagtctaaatccgataatattaataatttaaagccagggtttattcgcaaagagagtaaggttataaagattgcaaaatattttttggctattgggcttgaaaaatctgcaaagattatgtctgagcttgatgattcggacataatcttaattaccagagaaatttcaaagattagctatattgctccagaagaaaaagatcacattattaaagaatttgaagagttgataagaaatgaaaaaagatatgttaaggttgatgataactttgcttatgaattattaaataaaactttaggaaaatctaaagcaaaattaatttataaaaaagttactggcaatgatatttttattccttttgattatttatctcaaattgagcatgaacaactttgggcattagttaaagatgagaatattaaaacgcttgtcatattgtataattatttaaataaagatcaaaaaaagtatgttttttcaatgctagaagaagaaggtagaagagagtttgtaaaagatcttgctaaaccaaggcaattgagcatggagacaatagaggcaatttcgaataagcttaaggacagatttaagatgcaagggaggcttaagacagataaacttgatggatctaagatacttgttgatattttaagctatatggattctaatgaagagaaaagtctgcttaataagattaatatgcgagatttaaatcctgttgtggatagtgaaattcgagaaaaaatatttgatatcaatgtaatattgagaatcatggataatgatttgcataatattttaagagagtttacagataaagagattgcaattattattaaagataaaaccgatgaggttagagataaaatgctttcaaatgtttcaaaaaggcgtaaagaaattattttagacgaagaagcttttttagggaaaataagtaaaaaggatttaaaagctatgacatcatcttttgttaattatattaaaagtttaactttaaaaggtgatttagtaatatatagaaaaaatgaggaatttatt

SEQ ID NO: 527 - DNA, 2004 bp, Borrelia garinii
atgttaatttttggttttattggtttgttttttttaaatctttttagtttaaatgctcaaggaatagttaccaataaagatgctcaagaagagtttaaatgggctcttaattcctataataatggaatttatgatgatgctcttttgtcttttaaaaaaattttaagctttgatcctaataaccttgattatcatttttggactggtaatgtttattatagacttggttatgttgaagaggctttaatggaatggagaaatttaaaagatcaaggttataaggtcccttatcttagacatttgatttctactattgagcaaaggagaggtattttttcaaattacgaacttaattttaaaaaacttgtaaaagttgcttcccttgataattctatttataaaagaccacacgggtatcagattacatctttgagggctgataagtatggtggatattatgctgctaactttgtaggtaatgaaatattgtattttgatgttaataataatgttaatgctttagttaaagatggatttagttatgtaaaatcaccttatgatgttgttgaagctaataatttgctttatgtgactctttattcaagtgatgaaattggcgtttacgacaaagttcttggcgttaaaaagagatctattgggaaaaaaggcacaaaagatggcgaattgcttgctcctcagtatatggctattgataagagaaactatatttatgtaagcgagtggggtaataaaagagtgagtaaatttggacttgagggtgattttattctgcattttggttataaaacttcgggttataatgggcttctaggtcctacaggtattacttacttaaatgaaaacatttatgttgcagattctttgagaaacactattgaagtttttgatactagtggtaatcatttgtattcaatttttacttctattgaaggaatagagggccttagtagtgattctgctggcaataatgttataatatcttcaaaatatggtgtttataaatacaatattgctaaaaaaacaattacaaaaattttaaaagcagacaaagtaaattctaaaatttcttcatctattttggatgccaacaatcagatgattgtctcagattttaataatgctaaggtttcagtttacaagagtgattcaagcctttatgatagtttaaatgttgatgttagaagaatagttagacttggtgggcctaaaatttacgttgagcttaatgttagcagtaaaagcggattaccagttgttggacttaaaagtgaaaatttttcaattgcaaatgaaaattattacattgtaaatcccaaagtagtttataatgtaaatgcttcaaaagacattaatatagcggttgtttttgataaatcttcttatatgaaaaattatgatctagatcaaatagtaggtctaaatgctttaatagaatcgtcaaaaaataaaaactttagttttataaatgcaacaagtgtgcccattatagataatattgaaagtttgacaagcagcattaaaaacacaagttctcttggtccttatagtacagatactgtaaaaacagatgttagtttgaagctagcgggttccgggcttatgtcaaaaagctcaagaagggcagtagtttattttagtggcggtgttttaaatcataaagcttttgaaaagtactctttagatacaatagtaagctattataaaaataatgatataaggttttacttgatattatttggcaacgatcctgttaacagtaagcttgagtatttagttaatgaaacaggtggagctataattcctttttcatcttatgaaggagtatccaaggtttatgatttaattttagaacaaaaaacaggtacttatttgctagaatattattatccaggcccccaagagcctaataaatattttaatttatctgttgaagcaaatataaatcaacaaacaggaagaggagagtttgcatattttattaat

SEQ ID NO: 528 - DNA, 768 bp, Borrelia garinii
atggggagattatttcttctgtattttttatgctcttttgtttttttaaatttgtttgctcaagggagttcttcttatactgataaacaaaaagagcttgctattttttattatgaggttggtcaaaggtatataaatgttggcaaaattaaaaagggaaagctatttcaagcaaaagctttaaagttttatccagatttgaaaaagggagttgatattaagcttgtagttaaagagcttgatactaggattaaagatgacaattccaaggttgttatgcttgagaatgttaagcttgaggagataccaggaatagtgcacgaaaaaatagaaatcaatgattttacaaatgctcctaaaataggatatcttgctgaaagagaaagaagtaaaaatcaagataaaattattaaatttcaatttggaaagtttacaagagctttaatttctcagaaatttgatttgtttgactctgttgttgcggataaagttgatgttatgggtcaatttgaatcaaaaggtgattttatatcagctttatcaagagcttcatctaaggttgatgcagatgagttagagtatttatcagttgatgattattatgatttaaagtctttgaaaatttcaaaatccaatgatactgcttttgccgttaatgtgaataccaaaaaaaatgatgttactaaaaattttccattttggaaagaacatcagactttgatttttaccaaagaggatgataataattggtttttgtcttccataaag

SEQ ID NO: 529 - DNA, 1326 bp, Borrelia garinii
atgatgaggtctttatattctggtgtttctgggcttcagaatcatcaaacaagaatggatgttgttggtaataacatcgcgaatgtaaatacaattggttttaaaaagggaagagtaaattttcaggatatgatatcgcagtctatttctggagcttctcgtcctactgattctcgtggcggtactaatcctaagcaagttggattaggcatgaatgttgctacaattgacactattcacactcaaggggcttttcaaagtactcaaaaagcatctgatcttggggttagtggtaatggattttttattttaaaagaaggtaaaaatttgttttatacaagagccggtgcttttgatgtggactctgatcgacaccttgtaaatcctgcaaatggaatgcgaattcaaggctggatggcaagagatttagaaggtgaaaaggttatccatacagcctctgatattgaggatttgattattccgattggagataaagagggagcaaaatctactaaaaacattacttttgcctgtaatcttgataagagattgcccataattgaagaaggtgcaagttcggcagatattgcacgtggaacttgggttgttaataagtcattatatgacagttttggaaatgttagtgttcttgagcttacggttgtaaaagatctaaatactcctaatttatggaatgcaccagtactaataaatggtgagcaaaattcaaattttacaattggatttgacaatgaaggagcattggcgtctttaaatgggcagccaggccaaaaagaagatattctccaaattcccataacatttaatgttgtaggtgcaaatgtaggtgaagttggtgaacagcaaactgtaaatttgaaactgggaacagttgggagctatactgattcaattactcaatttgctgattctagtagtacaaaggctattattcaagatggatatggcatgggatatatggaaaattatgaaattgatcaaaatggtgtcatagttgggatttattcaaatggcataaggcgagatcttggtaagattgctcttgcttcttttatgaatcctggaggacttgcaaaatcaggcgatactaattttgtagaaacaagtaattcaggtcaagttagaataggtgagactgggcttgctggacttggtgatattaggtctggtgttttagaaatggccaatgttgatcttgcagagcagtttacagatatgatagtgactcaaagaggatttcaagcaaatgctaaaactattaccacttctgaccaattattgcaagaacttgtaagattaaaaaat

SEQ ID NO: 530 - DNA, 1344 bp, Borrelia garinii
atgaataaattagaagagcattatatagttcccaaagatgtggttttagaacttgataagtacataataggtcaagatgaagctaaaaaattagtatcaattgctcttgttaatagatatataaggtctagacttccaaaagaaataaaagatgaggtaatgcctaaaaatattattatgattggatcaactggcattggaaagactgagattgcaagaaggctttctaagttaattaaagctccttttattaaggttgaagctacaaaatatactgaggttggatatgttggtcgcgatgttgaatctatggttagagatttgatgagcattgcagttaatatggtaaaagaagagatgtataacactgtaagagatgatgcgttagtaaaaacagaagagagaatagttgaaagtctttttaaaggatctggtaattctgagaatgtagatccaaatgaaataaaggcggaggaaaaggtaaaagagaagcttagaaaaaagcttagagcaggtgagcttgataatactactattgaaatacaaatttctagtaaaatgccattttctacaatagaaatatttacaggtggtaattttgaagagattgatatgggaattggtggtttgttgggtaatatatttgatagaaaaaagaaaagagaattgaaaattaaaaaggcaaaggaaataattttagcagaagagcttgaaaaattggtcgatcacgaaaatatttcagatattgcaaaatctaaagttgaaaatatgggaattatttttattgacgagattgataaaatagctgctaagaataggagcggcaatgatgtatctagagaaggtgttcaaagagatattttaccaattatgaaaggctctaaagttaatacaaaatatggaatagttgatacttctcatattttatttattgcagcaggagcatttaatttggccaaaccttctgatttaatacccgagcttcaagggagatttcctattaaggttgagcttaagagcctaagcatagatgatttgaaaaaaattttaaaacaaacaaaaaattctctaataaagcaatatgttgcgatgtttaaggtttataatttagatttaaagtttagtgaagaggccatagatagaattgccgagcttacttttaatatgaatcttgagaatgaaaatcttggtgccagaagacttcacggcgttatggaaagagtgcttgcagatcttttttttgaggtacctggtagtaagttaaaaaaatttgaaataaacttggactatgttaataaaaaaatacaaattaacgaacaaaaagatttgaattattatataatt

SEQ ID NO: 531 - DNA, 681 bp, Borrelia garinii
atgagaaaaacaataataatagcgcttttctatggtttgatcacaaatatttaccctgaaataaaatcaacatcaaagctcaatgaacaagcaaacaaatataaaatagaaaaactttatcaaaaatcaatgctgttaaaaaactcaaaaaaatataacaaagctatagcaaatctaaaaaaaatagttaacatggatcaaaatcaagttgatgcccatcttttgctttcagaattggaatatttaaataaaaactggaagaaagcaattgttaaatctcaagattacttaaaaataatagactttaaagataaaaaaaactttttagatatctcttgggcatactttttaataggagaggttgaaaattcaatggactacataattaaatttttccaaagcggtaaggaattgttcaaagaaaatatatttatagcaattgatgctctttttaaaaaaagtatttatcattttataaataatgaaaatgaagcatttaatacaatattgacttcaacattccaattagcgcttaatgacgataccttattcataatttttttaaataatttagaaataataaaacaaatacccttctattattttaataggaaaaaattaaaagaattatacctacaaattagtgccttaaaaacaattcaaaacacaatgtgcaaaact

SEQ ID NO: 532 - DNA, 1128 bp, Borrelia garinii
atgaatataaagaataaattaatattgatgctgtgcattgtagtagcagtctcttttatcgcatgcaaaacgcctccagaagcaagagagagcaaaaatgctaaaattgcaaagccagatactaaaagttttgaattaagagatataaaagacattaaaaatgaagtaataaaagaaagaggacatcttttttattctaaagagttcaatgaagctgaaaaattagaagaagtaatgaaacaaaatttttctaaaaaaaaagcaaaagaagtaaatgaaattgcgctaaaagtgcttgaaagatataaaccaataataaaagaaccaagagaaaaaaaagaaaaagtaaattaccttaaagaaaatattgaaaagtatctaaacgatgcagaagcaaatgaagcatatatatggattcctttggaaatcgacgaagtaaacaacttgtacttcgaagcaacaagaaaatataaaaattacgatcttgacgatgcccttgacatgtatagcaaagcattcaacagagcacaacaagcggcaaaaaatgctaaagaagctaaagctttaaaagaaactgatgaaagaatgtataaacaattaaaagctcttgaagcggcttccaacttgccaatttatagcaacaataagcttattaaaccatcaccatggaatggtagagcatttattaaagaaagaaacagtcacttaaaccttttaaacattaatgaagacacctatcttcttggagaaacagaaactccaatagtactagcatatgcagaaaagttagaaatagcaaaaaactctaaacctcaagaacaattcaaaacactagaacttattgagcgatctagaaaattatgggaaaaaggagttgaggctaaaaatgtcaaaaactttagacttgccaatgaattatttttagaatctgcaagatacctagaagcttatcaaagcaatgcaagtagtgagctttatgtaataaaaataggcaataccttatggggcatttctaaaaaattatacaacgacccttacttatggccaaaaaattggtttggctacagacaaaaaatacaaaatccagatctgattcattccaactggaagataataattcctgctaaa

SEQ ID NO: 533 - DNA, 1581 bp, Borrelia garinii
atgaaattacaaaagttattattttcagtaatattttttctaacttttctttgttgtaataaagaggaaaaaaaagaaggaatatcatttaaaataagcctgggatcagaaccaagcagtcttgacccccaattagcagacgacaatgtcggatcaaaaatgatagacacaatgtttagagggcttattacaggcgatcctaacacaggaggaaacaaaccaggacttgcaaaaagttgggatatttctcctgacggaacagtttacacattcaccctaagagaaaaaatcatctggagtgatggggttgcaatcactgcagaagggattagaaaatcttatcttagaattttaaataaagaaactggctcaaattatgctgaaatggttaaatcaaccattaagaatggtcaaaaatattttgatggacaagtgtctgactctgaacttggaattagggcaattgacgaaaaaacattagaaataacactcgaatcaccaaaaccctattttatcgatatgttagtacaccaatcatttattccaataccgattcatattgccgaaaagtatggacaaagctggacaagccctgagaacatagttaccagcggtccttttaagttaaaagaaagaattcctaacgaaaaatatgtggtcgaaaaaaatgataagtactataactcaaaccaagtagaagtacaagaaattacattttatacaaccaatgacagctcaacagcatacaaaatgtatgaaaataaagaattagatgcaatatttggctccataccgcctgatttaattaaagatctaaagttaagaagtgattattactcatcagctgttaatgctatatatttttacgcattcaacacgcacattaaaccattagacaatgttaaagttagaaaagccttaactcttgctattgatagagaaacacttacctataaagttcttgacaatgggactactcctacaaggagaatagcccctaactttagctcatattcttatgcaaaaaatttggaattatttaatcctgaaattgcaaaaacccttctagctgaagctggttaccctaatggcaatggatttcctattttaaaattaaaatataatacaagtgaagctcataaaaaaatttgtgaatttattcaaaaccaatggaaaaaaattttaaacattgatgtggaacttgaaaacgaagaatggacaacttacctaaacactaggtcaaatggaaattacgaaatagcaagagcagggtggataggcgattatgctgatcctttaacatttttaagtatattcacacaaggatacacacaattctcatctcacaattattcaagcccagaatacaacgaacttattaaaaagtctgatcttgaacttgatccaataaaaagacaagatatcctaagaaaagcagaagagataattattgaaaaagattttccaatagccccaatatatatatatggaaatagttaccttttcagaaatgacaagtggacaggccggaataccaatattacagaaagattcgatttatctcaactaaaattaaaaaaa

SEQ ID NO: 534 - DNA, 1623 bp, Borrelia garinii
atgaattttaataaagctaagaaaattggtagaaaaatcaaaatagcagcactaattatgcttgccatatctttaattacatgtaataacaattcagaaaaggaaaaattaacatttaaagtatacatagggggagcaccttcatcacttgacccacacttagtagatgagacaatcggagcaagaattttagaacaagtattctcgggactcttagcattaaataccaaaacaggaaagctaatgcctggacttgctaaaaattgggaagcctcaaaagataaaaaaacatatcaattttacctaagagacaaccttttttggagcgatggagtttcaattaccgctgaagggataaaaaaatcttttttaagaattttaaataaagaaacagaatctacacatgttgatatgcttaaatcaataataaaaaatggacaggaatattttgatggaaaagtatctgattctgaacttggatttaaggcaattgatagcaaaacattggaaataacacttacatctccaaaaacctattttcttgaattgctcctacatcacacattcatgccagtgcctattcatgttattgaaaaatataaggagaattggacaaaccctgaaaacatggttaccagcggtccttttaaattaaaaaaaagattgcctaatgaaaaaattatatttgaaaaaaacgaacattattacaatgcaaaagaagtagaacttgaagagcttgtctacattacgtctgacaatgatatgactgtatataatatgtacaaaaacaatgaaatcgatgctatttttaacagcataccgccggatattgtaaatgaaataaaactacaaaatgactattatcaacacaaaagcaatgcaatttatttatactcgtttaatacaaaaataaaaccccttgatgatgctaaggttagagaagctttaacgttagctattgacagagaaactttaacttacaaagtacttaatgacggcacagttcccacaagagaaataacgcctgatcttgaaaattacaattatggcaaaaaattggctttatttgatcctgaaaaatctaaaaagcttttaacagaagctggatatcctaatggaaaaggattcccaaccctaacgctaaaatataatacaaacgaaactcataaaaaagttgctacatttattcaaaaccaatggaaaaaaattttaaatataaatattatgcttactaatgaaaattggcctgttcttaccaatagtagaaatacgggtaattttgaaataataagaattgggcgcattggagaatatttggatccacacacatacttcactatattcacaagcaaaaattctcaacttgcatcatacaaatatgcaaacttagaatttgacaagcttatcaaagaatcagattttgagcaagatcctataaaaagaaaaaatttactcagaaaggcagaatcaataataattgaaaaagattttcctgccgcaccaatatacatatattctggacactatcttttcagaaacgataagtggactggatggagtcctaatgtatcagaaatttattatttttttgaattaaaatcaattaaaaatgcaaaacgaaat

SEQ ID NO: 535 - DNA, 1197 bp, Borrelia garinii
atggaagaaaatgattttattaaatttgggagttatttgagaaaagttagaaatggtaaaaatttgactcttgaaatggtcgcggaggatattaaaatttctattaagtatcttaaagctcttgaagattctaatattgaaatttttccaaatgaagttttggctgttggatttttaagaacttatagcgaatatttagatattgattctagattgatatcaacactttttaaggattataaaagtaaacttaataatagttatattgggattagatctgaagataaaatttcaaatttgggatttttaagcgataataaagttttagataaaaaattgttttttttaaatttagagtccttaagtatattgaaaatcctgctaggaattgttggtgttattttgctattgtttgtgttttttgcttttagagaagtggaagtttattttaaaaaattttttaagcttagtcagaatgaaaagataatttcaaatcttcatgaagtatcttttgataaaaagaatttttggaatatttctcttaaagaaggagattctttatttttaacgtatggcgataatattgcaaaatatagagcatcttttattagtgacgatttagttattgttgatgagtctaaaaaaagtaaaaatatttttaatttaggagagtttaaagagataaatcttgatgataatataagagtcaaaattatttatgagaattattattatgataagtctaaaatagccaatgtaagtttagaatcttttgctttaaatgttaaatatgtatctgagactaatattgacaataggtttaatattttaaattggcagtttgatgttaagggaactgaaaaattaccaagtggcgattatcttactctatattcttctcagaaactttcaaatgttgatttaaaaatcgattttttaaatgatacattttttagatatgccgatgaaaacaatcttcatggcaagtctttttttgcatccaaaggtattcctattaatctagcttttgaaaaatctttgatactattcttttcaagactttctgatgttaatattattcttaatgaaagagatattactccttttttaaaagagcagggaaaagaaatttttgctgttcaattcttctgggtaaagacaccttcagggtttgatcttaaagtttctgaagtttat

SEQ ID NO: 536 - DNA, 1416 bp, Borrelia garinii
atgtctttgaattacgttgaaataaatactttgattaaagaaatccctttcgcaaactctttaataaaagaaataatacagccggattataaaagtttgattttagagatttacaataaaattgacaataaaaaatttaaaatattaatctctttaaatccaagcactaccagattccatataacaagaaaaaatttcaaaaagaatgctttaaaattaagattttctgacttcttaaaatcaaaaattcaaaatggaaaaattctaaaagcttcccaaatgaaaaatgaaagaataatttatcttgagatttttaaaaaggacataattatcttattcattaaattgtggccatcctctccaaatataatagctacaaaccaaaactttaaaatactggacgcatattacagaagaccaaaagcaaaagaaacaacgggtgaaacctttttaaaagctaaagaaatacatgaaagcaataaaatgcctgataaaaaaatcatgggtctaaaagaagaatacgataataccagccataaatcttattctgaatttcttgaaaattactacgaatcactcagtaatcaaattaaaaaaaacaatataaaagaattgcttattgaaaaatataaaaaagagttaattgctttagaaaaaagaatagggtctttaaaacaacaaatcaaactaattaaaaacattgaaaatgaaaaggaaaagggtgagttgattttattaaatataaacaaaatacaaaaagggatcaaagaaatagccctcttaaattataaagaagaaaaaataaaaatatcgttaaaccaatcgttatcgccaaaagaaaacgccttacaatattttaaagcatacaaaaagggcaaaaattcttttgaaaccatacaaaatcaattaaaagataatctagacaaatttaatctcattaaatcaaaaataaatatgttaaagatcaaaaatttcattccaaaagaagaatataatcaagaagaaactgctattaaaaaaaaagaaaaaacaccaaaaataggcttacattttacctcttgtggatttgaaattcttattggaagaaacgcaaaagaaaacgatgaacttttaaggcgctgtgttaaaggaaatgattattggcttcatacaagagattatcctggagcttatgtttttattagaaatcaaaaaaataaaactccttgccttgatgtccttttagctgctggtaatttatgcgtattttatacaaaattagcaaaaaaatcaggaaaagcagatctttactacacgcaagttaaaaatttaagaagggttaaaaacggaaaactaggccttgtaattccaaaagcagaaaaaaatttacatattaagctagatgaagatctaataaaaaaaataaaaaataaaacc

SEQ ID NO: 537 - DNA, 1797 bp, Borrelia garinii
atgaaaagagaaatatatgcatttttgagcaactttattatttttctatgttttttcctaggattaatctttagttattcttatttttttggagaaaattttttagaaaagcataggctaatagcagctttttttgattctattttgcttttttataagtatttttatggattttttatttttattgtttgcatttactttgctttttttgttcagcaagaaataaagatttatttaaaatcgtataatggatatttattttctaggctttatgcatttttactattattttttattatagggcttttttttacttttatatttaatttaatattgccttatataattgcccagagaaatgagtataagtttagttatgatagatataaccttcttgaaagtgaagcaaatgaaatatctcttaaaattaaaaatatagatataagtttgtcttcaaatagactttttttatctactgatttgtcagattcaatgaagcaaaaaaggaaacatcttgaaaatttgattagaatatatgataaaatgcgaattatttatgtaaataatgaagagcttttaacaaattattatttagtgaaatctgaatataataaaattccaagctatgatgttgatttggaaaaggttaaaaaaactttttcaaggtatcctttgcgaagccttaaaaagcaagatttttttaatattgttaatgaatttatttcccaaaatgattatcatacggccaattactttgcttatattgcttatgttgcaacaaaagacgataattttgttgcgcttttaaatttgactttaaagtttattaatgaaaacaggaattttgaaaaagaaaaaatgcagttgatttctgaagaaaagcaaaaaaattttttgtatcttaatactgaaaagtttaaattagcttattacggtttttctaatcttcataagctattgcccagtgataatgaaattttaaattataaaaataaatcgcttgaaaaacttaggaaaaagtatcttttttttgatgagattgaaaaatattttgaatattatggaataaacgatgtatttttattgcagccagattctaataaaaggttttatgattatatttatatgcaaaaagttgtcactcttaataattattctaaaataataaaaaattttgagcttattagatttaataaggcaggaaatgttatattgcatattaaaattccatttgctactttgagaggtaattttgtgtatcaaaatgttttaaacaaagacgatgagcagagtgaaattactcttaccaaagtttttgtgtctgtggatagttttgatacgaatgttttagaggttgtaaaaattaatgagaatgtagaaaatttagctttattttcaaatttctctgaggttggattttttttaaaaattcaaagtttgtcaagcgcttttaataaagttgctatattaaatttgaaattaattaatattttttccttgagcttgattttgctgatttctcctattttgctagttttaatgggggcattttttatctctttgttttctaaaatagaatttaattttaattccaaggctatgatttttttagtttcattaatgatagctattttttctgggattatttgtctttttgtaaattattttttaattgtctttacctctcttcttatatatacttttaatagtgtacacatatctttagctattctttcttcgttattgtttttccttatttttaaagtcattgttggaaattacaaggaaaagcatatt

SEQ ID NO: 538 - DNA, 1428 bp, Borrelia garinii
atgaaaaataaatttttaatatgcgcgtattttttactgactctgagcataagttctttagtaattgttgaatctatttttgctgttgatgagtctaataataataagttgtcaagatctagttatgagcagatgatgattcaagcttttgaatttgtaaaagaaaattatgttgaacctgtaaacgatgaagtgatttttgaaggtgctttaaaaggaatatttcaagccctaggggatccttattctcaatatttgacaaaaaaagatttagaagaaatttcaaaaacaacagtaggagattatgttggtattggaatttctataataaaaaaaatgcattctcaagataagcaagacaaggcaaaaaatcttgattctaatagcttttgtgtttctattgttacaccttttgagggaggtccggcttataaggctggaattaaatctggagattgtattatcgctgttgatggcaagagtgtttcttctatggaagtagatcaagttgttgatcgtttaaaaggcaaagagggtacaaaagttaaagtgtctattcttaggggaaaagatttaacattagattttgaacttacaagagaaaagatagaaatacaaacaatcaagtatgatgttattaatccagatattggttatataagaatagtaagctttaatccatacacttctgtagattttagcaaagctttagacaatcttaagaatagaaatattaaatctttaattctggatttaagacttaatactggtggatattttcaggcagctataaaaatggcagatgatattttatctaaaggaaccattgtttctacaaaatcaagaaattctagcaagcctattgattacaaggcaagctcaaaacaagttttgccttcagatataaaaatcgttgctttaatagatagatcatcggcgtcagcgtcggaggtttttgtaggggctttgaaagataataagagagcctatattataggcgaaaagtcttacggcaagggagttattcagcatgtagttcctttttatactggtggatttaaaattacaagctcaaagtattatactccatctggaaagagtatccacaaagttgggattgagcctgatttagaaataaaatctccagatttttctgaggaagaagcagtaatatataaagaaatttttgataaaaagctaatagaaggctttttaaaaggcaaaaaatccattactgagcaagagattgatttttttgttgagaatcttgttaaagaaaatccaaaatataaaattgataaagaatttttaggcaagtatgtgttttttaattactatcaagataataataaagaactcccaatttataatctacattatgacaaggttttaaaagcagcttgtgagtatttatctaaattaggtaat

SEQ ID NO: 539 - DNA, 1374 bp, Borrelia garinii
atgaaaaaacaaaatccatggatatctttaagcgaagaagaaaaaaatcaaattttcaatttttccgaaagttacaaaaaatttataagtaaatttaaaacagaaagagaagttacatcctatgctctagataaagcaaaaaaaagggggtttattgatgctgaggagaaaaaaaatttaattccaggcgataaaattttttatacctgtagagaaaaatctgttgcttttgctattattggcaaaaatcctattgaaaatggaatgaatttaattgtttctcatacagattccccaagacttgatgcaaagccttccccaatctctgaagaaaacgaacttgcatttcttaaaaccaattattatgggggaataaaaaagtaccagtggttatctacacccctttcaataagaggtgtggtattcttaaaaaatggagaaaaagttgaaatcaatattggagacaatgaaaacgatcctgtatttgtaattcccgacattttacctcatcttgataaaaaaatacaaagaaataaaaaatcagatgaaattattgagggagaaaatctaaaaattttaattggaagcctaccaatcgaatcaaaagaacaagataaagttaaactgggaactctgcaactaataaaagaaaaatacaaaatagaagaagaagatttcgtatcatcagaaattgaaatagtacctgcaggaacagcaaaagacgttggatttgacaaagctttaattggtgcttacggacaagatgacaaaatatgcgcttacgcttcactagaagctatatttgatcttgaagagattccaagcaaaacagctatttgttttcttgtagataaagaagaaattggctcaacaggctcaactggattagattcaagatatcttgaatattttgtttctgacatgatctttaaaattaaaaaatcagaatacaataatcttcaagtccaaaaagctttatggaattcaaaaagcatttctgctgatgtttgtgcagcaataaacccaatatttaactcagttcatgacgcacaaaatgctcccaaacttggctatggcatacctataatgaaatatacaggacatggtgggaaagttatggccagcgatgctgatgccgagcttgtttcttatattaggcaattattaaataaaaacaatatagcctggcaagtagcaacacttggaaaagtagaagaagggggcggaggaactgttgctaaattcttagctagctatggaataagaacaatagacatgggacctgccgttataagcatgcattctccaatggaaataacttctaaatttgatttatacaatgcttatttagcatacaaagctttctacaaggaa

SEQ ID NO: 540 - DNA, 1023 bp, Borrelia garinii
atgaggattgtaatttttatactcggaattttgttgacttcttgcttcgctgggaatgaaatagaatctggctcaagtaaaattaagatatctatgttggtagatggtgttcttgatgacaaatcttttaattctagtgccaatagggctttattgcgcttagaagaagattttccagaaaatattgaaaaagttttttctagtgctgcctctggggtttattctagttatgtttcagatcttgataatttaaaaatgaatggttcagacttgatttggcttgtagggtatatgcttacggacgcttctttatcggtttcattagagaatccaaaaattagctatggaataatagatcctgtttatagcgatgatgttcagattcctaaaaatttgattggtgttgtttttagaatagaacaaggtgcttttttagctggctatattgcagctaaaaaaagcgtttctgggaaaataggttttatagggggagtgaagggtgatatagtagatgcatttcgttatggctatgaagctggtgcaaagtatgctgataaaggcatagagattgtaagtgaatattccaattctttttctgatgttaatattggtagagccatagctaataaaatgtatgctaaaggtatagatataattcattttgcagctggtttagcaggaattggtgttattgaggcagcaaaagaacttggtgatggttactatgttattggagctgatcaagatcagtctcatcttgctcctaggaattttattacttctgttataaaaaacgttggcgatgcattatatttggttactagcgaatatcttaaaaataataatacttgggaaggtgggaaaattattcaaatgggattaagagatggtgttgttggcttatctaatgcgaataaatttgaatacataaaagttattgaaagaaaaatagttaatgaagagattattgttccttataatcatgaaggatatgaaatttttataaaacaaatattaaagtta

SEQ ID NO: 541 - DNA, 4131 bp, Borrelia garinii
atgaaagagataaaagattttgaaaaaataaaaattaaaatagcatctcctgatcaaattagaaattggtcttatggagaggttaaaaagtccgagactattaattatagaactttgagacccgagaaggatgggcttttttgtgaaaggatttttggcactacaaaggaatgggaatgttattgtggtaaatttaaatcaattagatataaaggtattatttgtgatcgttgtaatgtagaagttacccattttaaggtaagacgtgaaagaatggggcatattgagctagcagctccagttgcccatatttggtattacaaatatataccctctaggattggtcttttgcttgacattacagcatctagtttaaattctattctttattatgaaaaatatgtagtaattgaaccgggtgatactgatcttaaaaaaatgcaacttttaaatgaagatgagtatatagaggctagagagcgatatggaatgtcttttaatgcttcgatgggagctgaagctattaaaactcttcttgaaaatcttgatcttgatgaactttcatctaagcttaggattcaaatgatagataaagatgataaaactgataagaaacttttaagacgtcttgaaattattgaaaattttaaagtttctggaaataagccagaatggatgattatggaggttcttcctgttattcctccagagattaggccaatggttcagcttgatggagggcgctttgcaacatctgatcttaatgatctttacagaagagttataaataggaataatcgtttaaggaagttacttcttcttaatgcgccagagattattgtgagaaatgaaaaaagaatgcttcaagaatcggtagattctctttttgataattctcataaaagaaaggttgtcaaaggctcatctagtagacctcttaagtcgctttctgatgcgttaaaaggcaagcagggaaggtttaggcaaaatcttcttgggaaaagagtagattattctggtcgttctgttattgttgttggacctgagttaaagctgcatcaatgtggactacccgcaaaaatggctcttgagctgtttaagccttttgtgataagaaggttaattgagagtgaggctgtttttaatatcaaaagagcaaagaatttaatcgaacaagaagtggatgaggtatggcaaattttagattttgttataaaagagcatcctattcttttaaatagggcgcctactcttcatagacttggaattcaagcttttgagcctgtgttagttgagggtaaggcaataaaattacatcctcttgtttgtcatgcatataatgctgattttgatggtgatcaaatggcagtgcatgttccccttactccatcagcacaagctgaaagttgggctttaatgctttcaacaaacaatcttttaaatcctgcaaatgggcatcctattgtttttccatctcaagatattgttttaggtctgtattatttaacgatggaaaaaaagaatattgttggagaaggtaaaaagttcttaaactttagcaacgttattctcgctataaacaatagaagtctagattacaatgcttctatttatgtaaaaattgatggcgaatacaaaaaaactacagcgggtagggttatatttaacgaggctttgcccaaaggaattgaatttgtaaataaaactcttagtgatttggaactacaaattttaatatcaaaagtttatgtagttcatggttcttctactgtaattgaaatgcttgacattatcaaggagcttggctttaagtatgccactaagtttgggtgcacaattagtatgagcgatattattgttcctgatgaaaagaaaacttatatagatagggctaataaagagattgctaaaattcaaaatgattatgccaaaggtgttattactggtgaagagcgctataataatgtagtttctgtttggttaaagactaatgaagaacttactaataagatgatggaaattttaaagaaagacagagatggatttaatgttatatatatgatggcagattctggtgctaggggtagtagaaatcaaataagacaacttgctggtatgagaggattaatggcaaaaacttccggggatattattgagcttccaattatttctaactttaaagaaggtctttctgtgatagagttttttatatctacaaatggagctagaaaaggtctagcagatactgctcttaagacagctgatgctggatatttaactcgaagattagtagacattgctcaagatgttgttgttagaatagaagattgtggaactataaatggaataaaagttgaaactgtcaaaaatggtgaagaaatattagaatctttaaaagaaaaagctgttgggagttattccattgaaagaataaaaaatccaattactggtgagatcgttttagatgcaaatgaagaaatctcagaagccaaaatagaattattagagaaaattggtattgaaaagcttgtgattagatctgttttaacatgtgaagctgaacatggtgtttgtcaaaaatgttatggtagagacttttcaaagaataagcctgtaaatattggcgaggctgtaggaataattgctgctcagtctatagggcaaccaggaactcaattgaccatgagaacttttcatattggtggagttgctcaggccggcagtgaggatgataaaatatctttaaagaatgcttttatacttaatagcatagagggttttaatgttaatgttgacaatggaattcttttcacaagaaaaggaactttaaaaataatcaatgttttttatgaagaaaaaattaagaacataaaagagattaaagttttagattctcaaagagtaatcaaaggaattcctttgtttgttaataaaaagggtgtagagattctctcttcttatattggttatgctaaattaagagacgataaatttttaatagtatcagaagagcaagaagttgctttaaaagctggcacaaagcttgaaataggggttggtgattatgttgaatcaggtaaagttatcggcacatttgatccatttgcagagcctattattgcagaagttaaaggtaaaattaaatttaaggatattattttaggaaccactcttaaagaagagattaatactgaaacaggaaatgttgagaaaagaattacagataatgtttttgaatctcttgatcctaggatttttattattgatagtagtggtatggaggttgcatcttatgtattaccaggagatgcttatcttcaagttgaagatggtcaaaatattaatataggagatgttattgcgaaactttctaaaggctctgaaaaaactcaagatattacagggggattgccccgtgttaatgatctttttgaaacaagaatccctaagaatttaaccgaaatggctaaagtaagtggaattgtgcaatttaaatcaattcaaaaaggcaaaaggcttattaatattttagatgagtatggggttgaacataagcattatattccagccggtaagcatcttttagttagagacggagatgttgttaaagcaggcgatatgctttgtgatggcagaattaatccccatgatgtgcttgaaattttaggtgggattagtttgcaagagtttctgttggcagaaattcaagatgtttatcgaaagcagggtgttagcattaatgacaaacatattggtgtgataattaaacaaatgatgaaaaaagttaagattgtagcagttggtgataccaattttgtttatggacaaaaggtagataagcatactttttatgagcaaaatagaaaagtaatcgagcaaggtggtgagccagcaatagcaagtcctattcttataggagtaactaagacgtctctcaatatagattcttttatttctgcagcttctttccaggaaacaacgaaagtattaacagatgcttctattgctggaaaaatagatgatcttaggggattaaaggaaaatgttgtaattgggcatttaattcctactggaaccggtatgggactttataaaaaaattaaagttagtgaaaatatcgatgctaaggtt

SEQ ID NO: 542 - DNA, 3465 bp, Borrelia garinii
atgataaaaagagttcatctgggacaaggaagagctgatgagattttagacctacctaacctgatagaaatacaattaaattcttatgaaaaatttttacaacttgataaattaaaaaataaaaaacctttacttaatgaaggccttgagtctgtttttagaaatatatttcccatcaaaagtggaaatggtgatgttgctcttgagtatgaaaggtactatatagaaaacgatgcccttaattttacagaaaaagaatgtaaaagaaagggccaaagttatgaagctgttttaaaagtaagactaaatttacaatttttgactactggagaaataaggcaaaaagacgtttacatgggaactattcctttaatgacagaaaggggaacttttattattaatggggccgagagggttgttgtttctcaaattcatagatccccaggagttgttttttataaagaaaaagatttgtattctgccagaataattccttatcgtggttcttggttagaatttgagattgattctaaaaaggattatctttatgtaaagatagatagaaaaaaaagaatactcataactctttttttaagagctttaggatttgatacgagagaaaaaataatagaaactttttataacattaaaaaaattaaagttgaagacagtacaaaaagagatcttccgggtcaatatttagctaagagcattaatataagagagaatatgtattatcgagcaggagataagattactctacaagatgttgaagattttttgcaaaatggagtaaacgaaatagagcttgttgattttgatggttatgatgctatttctggaaagtgctttgtgagttcaaatgttattttaaattgtcttgagaaagaggatgccttttttgctttaaaggatggctctaaagagcttccaaaagaatcagttatgcttgctgtttatggtgctctttttcctggcgaaccaatatcgattgataatgctgaaaatgatttaaaaactatattcttttctgaaagaagatatgatcttgggcgtgtggggcgctataaactttctaaaaaatttggatttgacgatttaagtacatcggttttaactatgtatgatattgttaacaccatatctcatcttttaagaatatatgaaggtcatgatattcttgatgatattgatcatttaggaaatagaagggtgcgttctgttggggagcttcttaccaatatatataaaggcgcgatgtcaagagttgaaaaaattgctaaagatagaatgtctaataaggaagtttttaatctaaagccccaagagttaataagcgttaaacctattgtatctgctgttaaagaattttttgcaaccagccagctttcgcagttcatggatcaggtcaatcctttggccgaacttacccacaaaaggcgtcttaatgcccttggaccagggggactttcaagagatagagcaggatttgaggtaagagatgtccattatactcattatggcagaatgtgtcctattgaaactcctgaaggaccaaatattggacttattgtttctttagctacttattcgagagttaatgattatggttttttggaaactccctataggaaagttgttaatggagaagtgactgacgaattagaatatttatctgctattgatgaagagaaaaagtgcattgcgcaggccaatgccgcctttaattctaatggaaagtatcttgaagatttagtttctgttagaatttctggtgattatactacaacaaaccctaaaaatatagactatatggatgtttcccctagacagctgatttcagtatcttcggcattaattccttttcttgaacacaatgatgcaaatcgagctcttatgggttctaatatgcaaagacaagcagtacccctgctttttcctaaacccccaattgttggcacagggatggaaagtgttgttgcaaaggattcaggagtagtagttaaggctaaaagaagtggggaagttattcttgcaacaagtagtaaaatagttgttaagccttttgaatcagaaaatgctaaagatttagatgaataccatattgttaagtatgaaaggacaaatcaagacacttgctttaatcaatctgttttagttaaagagggtcaaaaggttgaaagtggagaaataatagctgatggccctgctactagatatggagagcttgctcttggtaataatttattactaggggttattccttggaatgggtttaattatgaggatgctatattaatatctgatagaattgtaaaggaagatctttatacatctattcatattaaagaattcagcatagaggtaagagaaaccaaacttggtcctgagaaggttacaggagatataccaaatgttagcgagaagatactaaacaaattagatgaaaatgggattatacggataggaacctatgtgaagcccggtgatattttagttggtaaagttactccaaagtcagaaggagacattactcctgaatttagacttttaacttccatttttggagaaaaagcgaaagatgttaaaaataattctttaaaagttcctcatggtactgaaggtacagttattgatgttcaaaggattactaaagaggatgttggtaatctttctcctggggttgaggagatacttaaagtttatgttgctaaaaaaaggaagcttaaagagggcgataaaatggctgggcgacatggtaataaaggtgttgttgcaaaaattcttcctgttgaagacatgccttatcttgcagatggaacccctcttgatatatgcttaaatcctttaggagttccatctaggatgaatattggacagttaatggaatcgcaattaggccttgctggtaaatatcttggtgaatcttataatgttcctgtttttgagtctgccacaaatgaacaaattcaagaaaaattgaaaaaagctggatttaatccaacttctaaagaaattttatatgatggttatacaggagagccgtttgaaaatgaagtaatggttggcgtgatttacatgcttaaattgcatcaccttgttgatgacaaaatgcatgcaagatcaacaggaccatattctcttgtttctcaacaacctcttggaggaaaagctcaatttggtgggcaaagacttggagaaatggaggtttgggcccttgaggcttatggtgcggctcacactcttcaagaacttttaacagttaaatctgatgatatgtcgggtagagtcaagatatatgaaaatatagtaaaaggcgttcctactaatgtatccggtattcctgagtcttttaatgtgctaatgcaagagcttagagggcttggacttgatttgtcaatttacgatgacaatgggaatcaagtccccttgacagaaaaagaagaagaattgattaataaaggc

SEQ ID NO: 543 - DNA, 1041 bp, Borrelia garinii
atggaaaaggtatttaaaataaaaaaaatttgcttttgtttgctgcttcttttgcaagcaaaaatagttcttgcccaaaatcaacacgacttaaaattcaataatgaatatttttactttaattttcaatcggcttattaccctccccatgagctaggaacaagtggaagtaacttttcacaaagctttaaacaccccaacttccaaaatattgaaccaagtttaaaaattccagccaattattggggaggaataaaattaatatcatacttaggatactataaaaattttaaagctttacacaatcctaattctatattttttaaaaacaatggcatagaagtcgatttaaatatcggattatctcctgtaagtatctcgcttaaaagcatgctaagctttactcctattgcttttttaaatttatatgtatcaaatgaaattggtatgggctggaaagcttttggatttaaggggattggtgtgcacattgaaaatggaaaatattcaaatgatattgaattttattcagaaataacaatagggggacgattccaatttgatttaaacgctatttttaaaggggaatggacacacattattacagttattggaaatgattttacatacttaattaatcctcatgcaaataaagatcaactttggaaatataaagcagacgatggcaaaaatataaatggcatgctaataaagccttacgctcttttagcttacaaaatgccaataccccttaacaccataggactactttacgaagggaaaacacaaattggcaaagaaagaaacataagctcatggaaaaacaaaggttggggaagtgatattttttatcacaatatttctcttattgctaattttgaagttgtcaaacctttaacaattggccttcaattaaaattatctacaaatcctacatacacaagtaacacagctgggctagctgatgtttcaaaaagaatagcaactggcaattcctatttttactacgattctatcggaatctctgtaacttataaatac

SEQ ID NO: 544 - DNA, 4488 bp, Borrelia garinii
atgaaaaaagcaaattttttaagtattaattttttaattttgcttttggtttgcttttttaacgttaatttattttctaaggatattttcaagtttaagcttgtagggcaatattttcctttttactataagaatggtaaaggaaaatatgaagggcttatttttcctattttagacaaatgggcaaaagataataattttgatattagagttgaaactattgacaatttaaatgaaagtaaaattgaagacgactccatatatttaggattaacttataggtcaaaattaaatgatttattttattttaaaagtgagttttcgaggagcattgcaattttattttctaaaagctctaataaaaaatataaaaatgctcattcaccatggttatctaattttaatataggagttgttaaaaatccaatatatgaagaattcttaaaactaagacgtgctaacactatttttttggttgataatgctgaagagttattattagctttaaaaaatgataaagttgactatatatatggcgattgtaagactttagcttatattgcaaagcgttttttaggtgaagatcttgcaatttttaatggagatattttttatagtatcaaaaatagggtggctattagtagaaatgctcctgagataataaagaatttaaatttggatttgttttcgtatttaatggaaatacccgatgaacatgttttttcttttttagatagtacttctaagggtaattttattgatattggcttatataacgattatccccctttaagttttattaattcaaaggggaagttgtctggtattttagtagatttatggaatcttctttcaaggcagcatatctttaaacctattttcaagggatttcctaaagaggatattaaaaaatcattagatggaaagtcagtaggcatttttggaggaattattagtaatgatagtgtatttaaaaatgttaattatgtggtaagtaagccaatatatcctcttaattttaaattttattctaaagggttaagcaataatgttggcccaataaattctcagtttattgattttgattttaataatattcaattaaataagaatcaagatattgttaataactttatagatattgttaataattcatatgggtttatagaaaattcaataacaacaaaatatttattaaaattaaatggatataacggtagattaaaatcttacgattcgatttttaataaaaatagatttttagtattagctattgataacaggatttataaggttattaaatatattcttaattctatatttgatgatatttcatttgaatctttacttcaaatagataaaaattggttagataaagaagagattaatagttctcgaataaatagttataaaattatgaataagcttaaattcaatatagaagaaaaaatttggttattaaaaaataataaattaaatcttgctgttaaaaattggtatccaatagattatgttgaagcaaataattataaaggaataaatcaatttttgcttgataagattagaatgttttcagggttagaatttaacataattgaaacacatagcatcttagatctcaaaaaattaatcaaatctggaaaaatcgatatgctaaatactaatgcgatcgattcaaatttagataatgtttttaatataaaattaaactctagaattccactttatattttttcaaataaaaaaagggtgcttccatctaggtctttagagaggtttgctgtacttgattttttgtataataaaaacttgacttctaatattaaatcaaaacttattttggtaagtagctttaaagaagccttacttcttctttataagggaaagatagatgggattattagcgatgagtatacagctgccgctgtttttgaagaattaaatgttgccgatgttgaaaaacttcctacttttagagatttggcttttgatttgagtcttgctatttataatcaggattatatcttgaaagaaattattcaaaaagttgttattcgttcaaacgttgatagtcagaagtatttaaatgattggaaatttgatatttattataaatccaaaggcattaggtttaaaaatttcaaatttttagtgttaacagtcattatattttattttacttttttaggatttgtaataattcttatgtttaaattatcgtttgagcagaaaagaaaatatttttctgtaatgaatgaaaaaaagattgcagaatctgccaatactgctaaaactatttttatagctaacattagccatgatattcggactcccattaatggaataatggcggctactgagcttttggataccactattcttacggatgttcaaaaagactatgttaggatgataaattattcgtctgattctttactttctttgattgacgatatattgtatttgtctcaaatagatgtcaatgaattatatgttgatagtcaagagattgatttagagagtgaaatggaaatggttttaaaaatttttcaatctcaatgtgcaaagaaaaatattgatttattctcttattctaaatctatttttaagaattatataaaaggtgacattgtaaaaattaaacaagttttaattaatttaataggcaatgcttttaagtttacagatgatggtgttattgttttaaactatgaagaagtatgtagaacaagagttgatgataatagagtattagttacagttgagtttaaggtaatagatacaggtaaaggtattaaaagggagaatctttctaagatatttgaaatattcaaacaggaggatgattcttcttcaagagtccatgagggtgcaggactaggattgtcaatatctagagagcttataaggctaatgggtggtcttggcattgctgttgatagtaaggtgggggagggggcaactttttcatttatgttgcctttttacttaggggatgagcttaaaagtgaaagtttatcaatcaatacatttcaattgataaatagtaataataaggttaaggtattgaatgtgctcttgagtcaaaaatctattaaaatttttgagcattgttcgactttgttgggcgaatcttctaatgtagattatgtagcgtcttttgaggatgcttataaatcctttaaggaagcccctttttataattttgtttttgtaaatgtaaataacgacaatattaaagagagtattcgatttgctaataatattgaaagactaagccctgatgtacaaattatttttttattttattatttagataataaagctttaaaaaatttaaaatatatgtatgttaaaaagcccttaatggggcttggcatatcttctattctttctaaaaaagagtttaaaatagaaacggattttgaagatttggttccaatagatagtgcttttaagataaaaggccctattaatgtgttaatagctgaagataatcaagtaaatcaaaaagtgttgaaagacattctcgttgtaataggtattaatgaaaatcttattgatgttgtagatgatggattaaaggctttaaaatctttaaaagagaaacaatataatatctcttttattgatataagaatgccaagatatgatggattttcagtggctagagaaattagaaaatttgaaaaggcaaagaatttaaagccatgtgttttggttgctgtaacagctcatgctttgcaagagtataaagaccagtgttttgaaagtggcatgaatgattacatctcaaaaccaatacacataagttcaattaaaattatattaaaaaaatatttacagtttgaagttgatgatacttgggagaataaagatttgaatcaacctgttaattttcctcatttagatattaatagagctttaaaagaattaaatctttcatatgcattatattctgaattatgtagaggccttgtcgattttatctctattaatattattgatttagaaaaagcttttgatgaggaaaatttgcctttaattagggacatatcacattcaatatctggagctctttctaatatgcgtagcgaattgtataaagattttaaaaaaattgaaacaagtaaagattcaatttatgagttgaaaaaaatgtattcttttgtaaaagatgatttattgagactaataaacaacataaaggagaatgttttacttgagtctgaggttattagtgagaataagttatactttaaaaacaatgatcaatttttaacccttctcaacaagcttttaattggtattaagactagaaagccaaaagaatacaaagaaattcttgaaagcattgaaaagtatgttttagacgataatattcagatattatttagtgatcttcgcaggaatttaagattatatagattcgctgagagctctaagattcttaaagagattattgaaatgtttagtaataagagatat

SEQ ID NO: 545 - DNA, 780 bp, Borrelia garinii; identical to SEQ ID NO: 307

SEQ ID NO: 546 - DNA, 1902 bp, Borrelia garinii
atgaattatgttgctagtaacattcaggtcttaaaaggacttgaggctgttaggaaaaggcctggtatgtatataggctctgtttctgttaatggtttgcaccatttggtttatgaggtggttgacaatagtattgatgaggctttagctgggttttgtgatagaatagatgttgttattaatttagataataccataactgtaattgataatgggagagggattcccactgatattcatgaagaggagggaattagtgctcttgaacttgttttaacaaaactgcattctggcggtaagtttaataagggtacttataaagtttctggtgggttgcatggcgttggaatttcggttgtaaatgcgttgtcttcatttttagaggtttatgttaatagggatggaaaaatttttaggcaaactttttcaaaaggtattccaacttctaaagtagaagttgtgggagaatcttctgttacgggaaccaaggttacttttttagcagattctgaaatttttgaaaccttagattataatttcgatgttcttgaaaaaaggcttaaagagcttgcttttttaaacgataaaatatacattacaattgaagataaaagagctggtaaagaaaaatcttcaaagttttattttgaaggtgggataaagtcttttgtagattatttaactaatgacagtaaagcttttcaatcagaatcttattatattgatggttttattaatgatgttattgttaatgtaggtcttaaatggactgaaagttattctgacaatattctttcttttgttaataatattaatacaagagaaggggggacccatgttatggggtttagaagtggccttactaaggctatgaacgaagcttttaaaaattcaaaaataagtaaaaaagatattccaaatcttacgggagatgattttaaagagggacttacagctgttatttctgttaaagttccagaacctcaatttgaaggtcaaacaaagagtaagcttggtaattctgagataaagaaaatagttgagattattgtatatgagcatttattagaaattattagttcaaatcccttagagatagacattattcttgaaaaagcaataagagccgctcgtgctcgtgaggctgcaagaaaagcaagagaatcagaaagaaaaaaaaatgcatttgaaagcttggcattgcccggaaaattggctgattgtgcttctaaaaacccctcagaaagagagatctatattgtagaaggtgattctgctggaggaagtgccaaaatgggtagaaatagattttttcaggccattttaccattgtggggtaaaatgcttaatgttgagaaaacaagagaagataaggtaattaccaatgacaagcttattcctataattgcatctcttggcgcaggagttggcaaaacttttgatattacaaaacttcgttaccacaaggttattattatggcagatgctgatgttgatggatctcatattagaactttgcttttagcttttttctttagatatatgagagatttaattgaaaatggctatatatatatagcaatgcctcctctttataaaataaagtatgataatcgtatttattatttttatgacgagaaagaaaaagaaaaatttttagattctattgaaactaaaaatcgcaataatatttttcttcaaagatataaaggtctcggggagatgaatccaacgcagctttgggaaacgactatggatcctgctagaagaaaaatgagattgataaatatagatgatgctattgaggctgaaaaaatttttgttactcttatgggagatttagttgagcctagaaaagaatttattgaacagaatgcactcaatgtaattaatcttgatgtg

SEQ ID NO: 547 - DNA, 1758 bp, Borrelia garinii
atgtttaaagttatcaaatgtaatgaattgaatgaaaaattgataaacaaaaaagttgaaataaatgcttgggtgaaaaaaatcagacaccacggaaaatttatctttctaaatataagagatagatatgaaaaagctcaagttctgataaccgaagaacaccttttaaagatagcagaaaaaataaaacttgaatattgcattaaaattcaaggattattaagtaaaaggcctcccaacatgataaacgaaaatatgaaaacaggatcttttgaaatattggcaaaaaacattgaaattatctcaaagtgtaatgaattgccatttatgatagaagatgacaataatgcaagtgaaaactcaaagcttaaatatagatacttagatttaagaagagattcattaaaaaataaaatcattttaagatgtcaggctactcatcttattagaaattttttagtaaaaaaaaaatttctagaactagaaaccccaacttttgtcaaatcaacaccagaaggcgcaagagactttgtaatcccatcaaggattcataaaggatctttttatgctttgcctcaatctccacaactttacaaacagcttataatgatagcaggatttgataaatactttcaaatcgcccgttgctatagagacgaagattcaagaggagataggcaaccagagttcactcagctcgatcttgaaatgagctttgtcaaaaaagaaaacattttcaaattaatagaaaatatgctttttttaatatttaaaaattgccttaatattaaattacctaaaaaattcaaaaaaataacatacaaaacggcaatgaataaatatgggagcgataaaccagacactagatttgaacttacattgcaagatataagtcgcaatctaaaaaattcagaattcaatgtattcaaagagactctaaaaaacaaaggttcaattaaaattttaatagtaaaagatgaagctgataagttttcaagagcaaaaataaataatttagaagaaattgcaaagctttacaaaacacaagggctttattttgcaaaaattgaaaacaacaaattttctggaggaattgcaaaatttttaaaaacagaagaacagcaattaataaaaacctattctctagaaaataatgatataattttctttacagctaataaaaaatgggaaactgcttgcaaagcaatgggccaaattagaataaaaattgcaaacgatcttggactaatagatgaaaataaatttgaatttctatgggtctacgactttccactatttgaatatgatgaaaatacaaaaacttatacgccagctcaccacatgttctcgcttcctaaaaagagatatattgccagtttagaaaaaatcccaaataaaaccataggtgaaatttatgatcttgttttaaatggtgtagagcttggttcaggttcaattagaatacacaacaaagaacttcaacaaagaattttcaacataataggatttcaaaaagaaaaatcagaagatagatttggattttttctaaaagcattagaatatggcgcccctaatcatggtggcattgcaattggtattgatagactaataatgctaatgacaaaatcaacttcaataaaagatgtaatattatttcccaagaattcttttgcgacaagtcctcttgatgactccccctctaaaatttccaatgaacaactaaaagaactcggaataaatattgttactgatgatgct

SEQ ID NO: 548 - DNA, 687 bp, Borrelia garinii
atgaaaacaatagatcatgaattttattatgaatttagggtagctgatgatgttagaatgatttatactaaaaagccttttcatctaaatttaagagaacttaataatgataatttaaattttgttcctaagtctaagaaaataaaatatttaaagcaattgcatacagatattatttatagggctgaagatgattttataaatttccaagaaggagatgggcttatatctagttctttagatgtagctcttgttgcttactttgcagattgtcttccaatatacttttatgattcagcgaaaaaaatcgtaggacttattcacagtggatataaaggaagctttagtttgattattttgaaaatgttgtttatgtttgagaaaatgggatcaacttttaaagatttaaaaattgtttttggaccttataacagatcttgttgttatgaagtttctgaaattttcttgaaagaagtaggtaataaatttagcaaaggcttattaaatactgtttttgacataagagatggtaaaatatactttgataatgctagttttaatttaaatttactttctagttttaatttaaatatttataattcaaaactttgtacgcattgtttgaaaaatctttattcttatagaagattaagagaaggacaaagttatgctttaatttggagaatt

SEQ ID NO: 549 - DNA, 1281 bp, Borrelia garinii
atgtatagttatattgtagaaggtggttttaagataggtggtcaaattacagctagcggcaataagaattctgctttaccttgtattttagcggctttacttaccaatgaagatgttattttagaaaatattcctaatattaatgatgtaaaagttgttttagatattttaagtgatataggagcagatattgtaagagagggaaatgctttaaaaataaaagtttcaaatattgtgaaaacagaaatagattcctcttttacggatttaattagggcttccatacttttattaggaccttttgtctctagatttggggaaatagatatggcgcttccaggaggagatgtgattggaaaaaggcggcttgatactcatttttatggcctttctaaactaggagctaagttaatcaacaaagatggaagaattgttttaaaggccaaaaagcttgttggagctgaaatgtttttagatgaagcttctgttacagctacagaaaatatcattatggcttcagttcttgccgaagggaatactgttattatgaacgctgcttgtgagccacatgttcaagatttatgtaatatgttgaattcaatgggtgctaatattttagggattggttcaaatgttttagaaataaagggtgtaaaaaaattaagaggaaccacatttagaataggtgccgacttcatgcaagttggttctttgattagtcttgctgcattaacagggggtgaattggaaattaaaaaagcagatccccaacatttcagattaattagacatatatattcaaggcttggtattaattttgaatatgacaaggaaaatgtatacgtaagagataaacaagagttaaaggttaagctagattttggcggacacattccaaaaattgatgatggtccatggcccgcctttccgacagaccttatgagtattattatagtcactgcaactcaagtagaaggcacagttcttgtttttgaaaaaatgtttgaatccaggatgttttttgtagacaaattaataaaaatgggggctcaaattgtactctgtgatccacaccgtgtagtagttactggcaaatctcctcttaaaggcaatgttttatcttctccagatgtgcgggcaggaatgtctcttcttattgctgcttttgttgctgaaggtcgcagcgagattcaaaatgtttatcaaattgaaaggggatacgaagatgtagctaataaattaattaatttgggggcaaaaattaagaaagttaaaagtcaa

SEQ ID NO: 550 - DNA, 627 bp, Borrelia garinii
atggaaagaaaagttttttctaaagatgggaaagagatcggtactataaatttggatgatagagtttttaatatagaaattagtcatgggtctatttataatgctataaaaaatgagttgtctaatcttagggttggaacatcttcaactaaaaccagatcagaggttaggggtagttctaaaaagccttggaagcaaaaaggaactggcagggctagagtgggtacaaagcgaaatccaatttggattggcggaggtatagcattaggtccaaaacccagagattatagctatagattgcctaaaaaggtaaaaaggcttgcatttaagtctgtattaagtttacgtgctgctgatgaaaataattttaaggttgttgagaattttaatattgaatcaggtaaaacaaaagatcttgctttaataatcaagaattttgcgagtttcaatggtaaggtagtcattcttttgggcaatgatgatcagatgattaaaagggctggtaaaaatataagagatttaaagattttgtcttttaataaacttagagttgttgatttgttttatgctaagaatttaatagccctggaatctgctgttaacaagcttaatgagttttatgttaaa

SEQ ID NO: 551 - DNA, 6486 bp, Borrelia garinii
atgatagattttgctactattttagttaacctttttttggtttcaatagttttgtttatttataggcaatatgacaagcgttctagggcgttagataaaattaaaaagttcatcgatcttgtgaaggttaatcttgaagattttattgaagataagacaaaagagattaatgatcttgctgttgatatggaagcttatcaaagatctagtatagaaataataaaaaagattgatgaagttcagccaaagattaaaaacaaaagcaatgattttgcagaggttgaaaaaaagatagcttatcatgattctatgctcaaggatcttgatgaaatgaccttgaaagttcaagagaatattcaaaggttgcaagttgatgggaaaatagtagataaactttcaaaaactttaaaaggatttaatactcagattgattctgttgaatcaaatttgaattcagtgttagaaaaatttgaaaagtccaataaagaaaatctcgagtctattaaaattgctagttgggaaaagtttgatattaatattaaggaccttgtttttaaaatggataatttaaacagagagattgatctttatgaaaaagatttagcaaatattgaagagagaaaaaaggatattttagataagggtaatgagaaattagatttagaatttaatgattttcttgaaaaggttgaatttaatattggtaaatataataaagagatagaaagttcttttattttttatgaaaacaaatataagttaatagaagattctatagagcttattatggagagcgtaaagaataaaattaatgagaaagaagattttattttaaatagactgaatgaggaattagaaaataaatttaaagatatcttcacatacgttgatgatcgttctagggaaattcaagataaacttgaggataaattgattttagtggacaatgaaatttcttctatgagttcttctttcaaggacaatgtttattcaagaattaattcacttgaggagtcaatacgaatagagatgggaaagtatgaggagcaggttgatgatgtttttgataaatttagatctcaagttgaactgaatcttaaaaatatttatgaggactatgaagataaaataagccaagttgataagaatattagagaaagggtagagcttagtttgttagatttgaattctaaaatggaaagtgttcaaacaggtgccatctctttgatcaagagacttgaagatgattctaatcgaatatatcttgaatttaaaaataagtttgagtcagacattgaaatatttagtgaaagttttaaagatgatattaatcaacttaaaaggcaattagaatctcaacttttagatgttgattcaaatatgcaagaaaagcttattaagcttaatgataatttgatttctaattttcaagaaattgatggcaggtttaataataattattcaaatttaactgataatataaattccaagtatattactctttttgaatctttagattctagtagctctaaatttgaagatcaaatggaatctaaatataaaggctttaaagataaattaacggcagaaatggatgagttttctttagtttatagtgagaaatttgacacgctctctcaagaagcaattaataattatcaagaatttcaagatttaaacaagaaattagaaaatgaaattgaatctttgtgtaatatgtttgaagaaaaccaagagattttaaagagagattttaataccaatttaattaatattaaagatgaaattgataaaaatatagtagagtttaaggatcgttattccgatgaggtaaataattttgttagtaagctagaagaaagtaagcttcaatattcaaagtggcaaggtgatatggattctaatttaaaaaatattgaatctcaaataaataaaacaaatgaagaatttttaagtttaattcagattcaaaaagacaagggaatagaacttagtgaaaatgtttttaatgatctttcagatcatattcaaaagaaagctattgacattcatggtagttggaaagatgagcttattgctttaaataaatcattgcttgatattaagatttctagtgaagagctactttcatctgctactttaaaaatagaaaatctagaaagagatgttaacgatagaatagaatatgttttgttaaaaacaggcgatattgagagtttagtgatagaaaaatataaagaattaaaagatatgtcatattcacaaagtgacgaggctatattaggaattaaagaatttattaataggcaaacagaaataattaaagataaaagcgtatttatgcttgaggatttgaataaaaaatttgatgataagaataattttgttataagtaagattgaagaatgtgattataaattaaaagatttcaagagtgaatcagaagatattttaaataattttaaatctgatcttaatgaatttattgaatcaaagctacaaattgtctctaatataaaatcggacaatcaaaagcaaattgatgattttttagatagaatttctaaagatattttaaataggaaagattcaattaacaatgaagtagacagtaagcttaatgattggcaaagcaaattaaacgaaataactgttaaaattgagaatttattatcttcgggtaaagtggatttggatttaatagattctgaggtgactacaaaaattaaagagcttaaattttccatagaaagccttgagagttattaccttgaaaaaatagatgagtttagaaatcaaggtgctatatattctgacgagcttttacaagatataatgaaccattttaataaagagactagagaacttgaggaaaatttgtcaaaaaagtttgctgtagttttaaataattcagaggaatttgttaaagaggttgatagcttgctgcaggataaaagaaccgatattgcgtcttttcaggccaatatagatattactcttgattcccttagtgtaaagtttaatgatataaataaagaaattaatggaaaatataatgaggtgatatctaattatagagggtattcagaaaatatttctagtaaacttgaaaatgaaataatgcatgagattgaaaatataaatagaagattgacagatagaatagataatcttagcaaaggtatggatgaaaatcttcaaaaacttaaggaatcttttgatgtatcaaaatatcaagttgaaaaatttgaattaaaagttaaagatctaacagactctggagaggcaaaaattagtgagtttattaaagagattgaacagtattataaatctagattagaggaagcaattgattataggagaacgattgatagtgatattatgcaagcaaaagagagatttggagagataacaaatgatcttaaaaataatattgagagtaagtctgagtttttaaacgatctttataaggaaagatttaaacttattgagagtaattttgaagagaggtattctacgtttttaattgaaagtgaaggagctatttcaaaaattagagatgaaatttataaaacacttacaataaatgatgaaaatttgcaaattaagatttctgaaatggatcataattttgagataatagagcaaagatcaaaagatattttagagtttgaaaaagaattgagagataaaattcaagattgttacggtattataaattctcaatttggagagattaagggaagtgttgaagagaatataaaaaatcattttgaggtttgtataaaaaaggtcaacactttaattgatgatgacattgtaaagtatgaaaatgaaattcataagagaatcgattctttaaaatcgattgaaaatacttttgatagcatagagaaaaatttgaatgataaagtgaatgggtgcattgataaaatatccaatgattttaatcttaagtatattgaacttgaagaaaggtgtaatgaagggcaattaaatttggagagtaaaattgacaataaaattaaagccattgataatttagctttaagtcaatatgatgggcttgagaaaaagtatgctgatatgtacgatgagtttttagagagattaaattctcatattgcaactttaagtgaagagtttaagcattcaaataaagagatgatttttgaacttgaatctcaactgaaaaatcttaaaaatcttgaatctgatttaaataatgttgaaaaggatgttattagattgaaagaagagtcttatcataatgtttcatctcatcttaagctattagaagaagatttttttaaagatttgaaaattagaggtgaagagcttaaatattctttagaaaactttattgcttcgcataatgataaaattcaaaatttagaatatgatttgtctaaaaatctagaaaataaaacagaacttattcaaagtttccgcctagatattgaacaaaaaatgaaaaatgataaagaaactttttatttagattttactaaggaattttcttctaaaaaaaaagatatggagagtgagatagctttaatggaaactaatattactgaaaggatagatgaatttattgattttgtaaataataggcaaaatattattgattcttggtttttaaatattaaagatgatgtaaaaaattggcaagaaaaatcttatagtgcaatagaaaagaaaataagtcttgctgaacttgaaattaaatcatttgagaatgatattcttaatgttaagattggtttagaatcttttaaagatagttttgagattaaggctgaagagatttttggcaatttgcaaagcgaggctaaaaaatttgaacaatcagttaatcttgattttaaaaatattggtgagtcattaaatcttaaagttttagatcttgaaaaatttgttgattttaaagtagaaaagatagacgaaagggttaataagaaaaccgaagacatcttaattcaagcagaagtgaaatttttaactcagcaaaagagccttgaagataggatttttgagcttaatcaaaaattagagaatgagtttacaaccctgtcttctaatcttgataaagtaagacgagaaatgattgatgtaatttctagtgataaaaaaagctttgaaggtcaaattgaattaatgcataaaaatatttcagaattttctgaaaaaattggtttatatagaaataatattgagacatcaattgagaatgaatataatgcgttttctaaatctataaaatcagagtttggcttacttgaagacgagcttaaaaaaaatttaaaacattcaacgttggagattgaaactgtaaagaatgatttgcaagaacaaattgataaatttgaggttgagttcaagaaaaatcataaaaaattattgaaagaagttgatactaatattttagaacttgaatctaaaatattaaattgtgatactgaatttaataaatttattagtgaatctaaagacaatttggttgaatataaatctgatttgagaaaagaatttgaagatagttatgataaaataaattttcaaattgaaaattttaagaaactagatgctgagcttgaaaaaaataattcgatatttttagaggcttattctcttaaggagaagttggaaaaattatgggaaactttaaaaaatgagataaatcttgctcaagaatataaaaataattttgaaaatgttaacaaggaattctataatattcaaaaagaaacattaggtattattgaaacttttaatgagttgaagttagaacaagaatctattaaagctattaagaatgattttaatagattttttgaattttactcttcatttgatagtagatataagagtttaatcgaatcttatgatgaaatgcaaatttataaagccaaaataaaagaaatagctgatgagcagagaaatattcttgataattatgaaagaattagcaataaagagggtatattaaagagtactatagagtccgttgataaaaactttgatttaataaatgaaatggagaagagatttaataatttaagtaaagagagtgctaattttcagaacaatctaaaggatatggaaaatgttgtttcgaatctcttattaaacaaagggctttcagaagaagtattgattaatgctcagaatttaaaggaaatgctcttagatattgaaaataggttaaaaaatactttaactatgagagaaaaggtagtgaaatctgaaacaaggctagagaatttaaatattgcggcagaagaaagaataaaaactcttggtattcttgtcaaaacagattctaaatatcaagataatgttggtcttaataatgaaactgttaggaattctgtaataaaattaatgagacagggatggagtgctgaagaaatttctagagctactaaattatctattggggaagttgagcttattttagagcttggtataagcaataaaggtgat

SEQ ID NO: 552 - DNA, 1905 bp, Borrelia garinii
atgggcaaaataataggtattgacctaggaacaacaaactcatgcgtagctataatggagcatggaaaaccagttgtaatacaaaattcagagggtggaagaactactccatctattgttgcttacacaaataaaggcgaaaggcttgtggggcaagtcgcaaaaaaccaaatggttacaaaccctgaaaacacaatttattctattaaaagatttatgggaagaagatttgaagaggttgcaagcgaaataaaaatggttccttataaaatagaaaagggactaaatggcgatgcaagagtaaacatttccaatataaaaaagcaaatgtcaccgcctgaaatctcagcagcaacccttacaaaaatgaaagaaacagcagaagcttacttgggtgaaaaagttacagaagctgttattacagttcctgcgtattttaacgatgctcaaagacaagcgacaaaagatgctggtaaaatagccggccttgaagtaaaaagaattgttaacgaaccaactgccgctgctcttgcttatggaattgaaaaaaaacacgaagagattgttgctgtttacgatcttggtggaggaacatttgatatttcaatattggagcttggagatggtgtttttgaagtgaagtcaaccaatggagacacacatcttgggggagacaattttgacgatgagataataaagcatttaatttcagaatttaaaaaagaaagcgctattgatttgtcaaacgacaaaatggctcttcaaagactcaaagaagcagctgaaaaagctaaaatagaactttcaggcgctcaagaagcttcaataaatcttccatttattacagcagatgcaaacggcccaaaacacttgcaatatactctaacaagagcaaaattcgaacaaatggtagaccacttagttcaaaaaacaaaagaaccatgccttaaagctattaaagatgcagggcttaaagcctctgacattaacgaagtaatacttgtaggcggatcaacaagaattcctgctattcaaaaaattgtaaaagatatatttggacaagatcccaacaaaggagtaaatccagatgaagccgtagcaattggagctgctattcaaggtggtattttaaccggagaaaccaaagacatggtactccttgacgttactccactctcactaggaatagaaactctaggtggtgtaatgactaaacttattgaacgaaacactacaattcctacaaaaaaaagtcaagtattctcaacagctgctgataatcaaacctctgttgatattaaagtccttcaaggtgaacgtgaaatggcagcacaaaatagaatacttggtaactttatacttgatggaataccagcagcaccaagaggagtacctcaaattgaagtaagctttgacattgatgctaatggaatagttcacgtatccgcaaaagatatgggaacaggcaaagaacagaaaattagaattgaatcatcatcaggactctctgaatcagaaatagatcgaatggtaaaagatgcagaagctcatgcggaagaagataaaaaattaaaagaaaatattgaggcaaaaaatacagctaattctttaatttatcaaacagaaaaatcattaaaagaatattctgaaaaaatttcaagcgaagacaaagaagctattgaaaataaaataaaagaattaaaagaaagtcttgataaagaagacatttcacttataaaatctagaacagaagaacttcaaaaagcttcttacaagatagctgagatgatgtataaagattcttcacagcaaaatgcaagcaaccaacaagaaaatggtacccaaagcaatacaagcgaagaagggaaagaggctgattacgaagttgttgacgaggataaaaaa

SEQ ID NO: 553 - DNA, 561 bp, Borrelia garinii
atggaaaaaaaagaaactaaaaacgatgccgaaaaaaacaacaaacaagataacaaaagtacaaaatctcaaaaaaaagaaaacttaaatttggtaaattctgataaaaaaattaccgagcttgaaaatgaaatctccaatcttaaagatttgtatttaagaaaacaagcagaatttgaaaacttcagaaaaagattagaaaaagaaaaagacaattttgttaaatttgcaaatgaaaccataatgaaagatgttgttaattttcttgataacctagaacgagctattaactcttcaagaaaatctaaagattttgacaacctattaacaggaatcagtatgattgaaaatgaaatactatcaatctttgataaaaaatataatttaaaaaaatttggagaaaatggcgaaaattttgatccaagtcgtcatgaagcaataagtattgaagagaaagaagatcttaaaaatccagaaatagtagaagtataccaaaaaggatattgctacaacgacagaatattaagaacagcaaaagttaaagttgctcaaagtaaaaat

SEQ ID NO: 554 - DNA, 681 bp, Borrelia garinii
atgaaagatttgaatgaaaacaatgataataataaaggattttttgtagcattaacctcgattgcaacagtttgtatcataatatttcttgggacaattattttctttccaaacaaaaatttggcctcagatattgcagagaagaatattgttttagaagaagccaaagatcaaaacattttagaaaatattgacgaaaatgaaaaatctttaaaggtatctgaaactccaaatgaaataataatagatttaacacaagatttaaataaagaaaaaaaacttacaagtaaaacccctaatacttctcaaaaatcaaaacctattgaaaaatctcaacccgtagctaaaaaaatacctaatacttctcaaaaatcaaaacctattgaaaaatctcaacccatagctaaaaaagctttagatattgatagcgtatatgaccctaatacagaatattacatacaattcgtatcactctcagacccaatcaatgcagacaactatattcaaaaattactcaaatataatatagttgccaaaatatattctgcaacagtagataataaagatatttacagggtaagatctggtccttataaaacgaaatcagaagcaaaagcagactttaaaaaaataacaggaataagtgaatttaaagaaacttatatattacccgttaacaaa

SEQ ID NO: 555 - DNA, 1485 bp, Borrelia garinii
atgaataaaacaaaaaatcaaagctttaaatattttataatgcttttatgtatatcattatttggggctaataatacaataaattactctagcattgaaattcccttagaagacttaagtgaagaatttaaagacactgggaataaaaacgatcaaataaatacctcaaaacatttaaacaaaaaaatagtttcttataaagaccccaaaaagggtaaagagctaaaattgccagaaaatataagagacgaaaaattgttaaaaaaaagaatggatgaaaatgatctaaaatctataatcgaaaattatgaaaataaaattaaaaatatagaaaagcttttaaaagctaaaaatcaaaaagcatcgtcaaatgaaaataaaaaaatagaatcaatcgaaaaaaaagcaaaaaaatatgaaattttaaccaacaaattaaaaaacgaaataacagaaataaaaaagctccttaacaagaggtccaaacctaaagaagatgaaaattatgaaaaaataaatattgaaaacattgatgatgatgatgatgattttgaagaaaattatgaatataatgatgaaattgaagaaataaatgaggacaagtacccttctaatgaaggaataataaatagcctaaaagaaaaccttcatgcaaatgaaaaatattatgctattaatgaaaaaaaaatcgatgaacttgaagacagaattaatgataatgaaaatactattttagacttgcaaagagaattaagaaattttaaaaaaaaagataactcagataaaaacttagaagaaattgaagagaacttatcttcaataggaagaataattaatgacttaaaagaaaaaattagcgcaaatgaagcaataaataaagaaaatcaaaaaaaaataagaaccgataaacataaactcaaagaattagaagataaaataaaggaaaatgaagagactattttgaaacttcaaaaagaattaaacaattttaaaaaaaaagaaatttctcaaaaatcttcaaacgaagagacttttattccaagtattacaaacaaaaatgacgagctagaagaaagtaataaattagaaaagaaatattttaagcctatagaaaaaaatgaaagcgaagatctagaagaaaaagccaaaaacactaaaaaaacaactatgatcaaaacagcaaattttcaagtctaccctgacatatacattaataactataaattcaaggaaaaaggggatcaatttgcatttaaaaaagaaaacacatactatattgaaatagatccaaccaataatttaaatgaagctctaaaaaatcatgaaataatctcaaaatataaatttgaaaaatatttcattaatcctactctaaaaaataaagaagaattttttaggaacttaatagaagttaaaaatatccatgaactaggaattatgtataaaagcctaaagcctaaatttaagcaaataaaaataattaaa

SEQ ID NO: 556 - DNA, 1848 bp, Borrelia garinii
atgaaaaaacaatttgatacagaagtaaatgatttgctctatttaatcattcactctctttactcccataaggaaatattcttaagagaattgatatcaaatgcatctgatgccattgataaactcaagtttttaagcttgacaaatgaaaaattcaaaaacatcgccctagaaccaaaaatagaaataacatttgatgataaaagtatcctaattaaggataatggaatcggaatgaatgaacaagacttaactaatcatcttggtgtaattgcaaaatcaggaactaaagaattcattaacaatttaaaacaagatgaaaaaaaatctgcaagtctaattggccaatttggagttggattttacagtgcattcatagtatcagaaaaagtagaagttacatcaaaaaaagcactagaaagcgatgcttatatttggttcagcgatgggaaaacaggatatgaaatagaaaaagcaaaaaaagaagagtcgggcacagaaataaagctttatctcaataaagaagggcttgagtatgctaataaatggaaaattcaagaaattattaaaaaatattcaaatcacataaattatcccatttatataaaatacagcgaacctataatgaaggacgggaaacaagagggaatagaagaaaaagaagagaaattaaatgaaaccactgctctttggacaaaaaataaaagcgaaattaaagcagaagaatacaatgaattttataaaaatacaacctttgattatgaaaatccattgatgcatgttcatacaaaagctgaaggaaatttagaatatactaatttattttatatcccaagtaaagctccttatgatttatattatccaaacaccaaacctggagtaaagctatttataaatagaatctttattacagactctgaaggtagtttgcttccaaactatctaaggtttataaaaggaattatagactgccaagatttaccgctcaatgtaagtagagaaattttacaacaaaataaaattttgtctaaaataaaatcatcttctgtaaaaaaaatactaagcgagcttgaaaagctaagcaaaaaaaatcctgaaaaattttcaaagttttctaaagaatttgggagatgtattaaagaaggtgtttattctgactttgaaaacagagaaaagcttatctcattaataagatttaaatcttcaagcgtagatggatttgtgtcttttaaagagtacaaagaaagaatgaaggaaagccaaaaaagcatttactatataacagggggtaaagaaaatatattaaaagaaaatccaatagtaagcgcttataaagaaaaaggatttgaaatcctaatcatggacgatgaacttgatgaggctattttaaatctaattccagaatacgaaggattaaaactaaaagcaataaacaaaaatgaaactagcaatgaattaaaagatgaaaatttcaaaaaaattgaagaagagttcaaagatatacttacaaaagtaaaagaaatccttaaggaccacataaaagaagttaatctctcagcaacattgataaaagagccttcggcaataatagttgacagcaatgatccaacttaccaaatgcaaaaaatcatgctatcaatgggacaagaagtaaaagaaattaaaccaatacttgaactaaaccctaataataaaatagtccaaaatttaaaaaatctagagtctgaaaaattagaaaaaataagcattctcctattcgaagaggctctgctaacttcaggaatgcctagcaaaaatccaggaaaattcataaacataataaacgaattcctagaaaaagagttgtta

SEQ ID NO: 557 - DNA, 687 bp, Borrelia garinii
atgcttgaaataataagtcttgggggaggagtaataaattcaaatcaaatcaacatagaattcattaaaaatttcaaaaactttgtttttaaatggttactagaaaatgaaaaaagaaaaatcattttaatagttggtggaggaaaagttgcaagagaataccaagacgcctataaaaaaatcaaccctgattttaaagttcgtgagcttgatgagattgggataatgtcaacaaggttaaatgcagaatttctctgcaaagtgatgaatcccctttgtaaagacaaaattgtcaccaatcccttaaaaaatttttcttttaagggtaaaatattaattgcttccggatggaaatcgggattttcaacggattacattgctgtaaaatttgcagaaaaatttaataaaaaagatgtcataaatataacaaatgtaaatcaagtttatgataaagatccaaaaaaatttaaaaacgcaacagcttttaaaaaattaaattggaaacaattacaaaacattgtaggacaaaagtggaatccgggcttaaatttaccttttgacccaatagcaacaaagctctcttcaaaacttggacttactctttatatagtaaacggaaataatattgaaaacttagaaaaagttttcaacaaaaataatgattttttgggtactgttatagtaaaa

SEQ ID NO: 558 - DNA, 3441 bp, Borrelia garinii
atgagttttaaggctaaatttattcatcttcatgttcattcagattattctcttttggatggagctgcaaaaatatcagatattatatcaaaagcaaaaaaatgcaatatgtcacatattgcattaacagatcatggtaatctttttggagctattaaattttataaagaagctaaaaaagcaggaataaagccaataattggcattgaagcttatatggcaaaaacttctaagttttttaaaaaacatgatgatcttgggaaaatgtcttatcatttaattttgcttgccaagaatgagataggttataaaaacttattaaagttaacaagtatttcttatcttgaggggttttattatcgtccaaggatagataaagaggatcttgaaaaatattcagaaggtttaatttgtacttcagcttgcattggaggactcattccaagacttattttggggaatagatttgaagatgctaagaatgaaattctttggtttaaaaaagtttttggcaacgatttttatcttgagcttcaaaggcatggcattaaagatcaagacattgtgaatgaaagacttgttgaatattctagagaacttggagttcctttaacggcagctaatgattctcattatgttaatagagaggatgcaattgctcaagacatcattgtttgtattggtactggtgccaagaagagcgatgagaatagattgaaaatggaaaccaatgaattttatattaaatctcaagaggaaatgtgtgaactttttaatgatttgcctgaagctttagaaaatactgtaaggattgcagaaaaatgtgatgattttaaaataacttttccaggacctattttgcctgattatcaaattcctattgaatttaatactcttggtgaatatttagaatatcttactcttgaggggttaaagtttagatataaaactttgacaagcaaaataaaagatagagctttttatgaattaagtgtaataattaggatgggctttgaaggctattttttgattgtttgggattttattaaatttgctcatgataacgatattcctgttggagctggtcgtggttctggtgctggttcaattgtagcttatgctcttaggattacggatattgatcctttaaagtataatttgctttttgagagatttttaaatcctgagcgtatttctatgcctgattttgatattgatttttgtttcgaaggcagagatgagatcataaaatatgttaccaataaatacggagaagataaggtagctcaaataattacttttggaaccttaaagcccaaggctgtagttaaagatgtagctagagttttagatattccatttgccgaatcgaatgaacttactaagcttattcccgatggtcccaaagtttctttaaaagaggttttagatgacaattctttgaaagagtattttactagcaagcctgtttataaagaattaatggatgctgcattggttcttgaaggaatgaatagacatgcttcaactcatgctgcaggaattgtaatttctaaaacccctttaaccgattatgtgcctctttataaggattataagcaaggctctgtttctactcaatacacaatggatttgcttgaagaatgtggacttgttaagatggattttcttggcctaaaaacattaactttaataaaaaatgcagaaaatcttattagaagtgtaaatccagattttaaaataaaaaatattccagataatgatgttaagacttttaagatgctaggagaaggaaaaagcgcttctgtttttcagttcgaatctgagggaatgcagcaaattctaaaagacgcaaagcccgataatattgaagatttaatagccttaaatgctctttataggccaggtcctatgcaatttattcctcaatttattgctgccaaaaaaggcgtaaagagtattaagtatcctcatccagatttaaaggaagttttaaagccaacttatggagttattgtttatcaagaacaagtaatggaagtcgcaaaaataattggaggtttttctcttggcaaggctgatattttaagacgtgctatgggaaaaaagaaagaagatgagatggatgaaatgaaggtcgattttttaagaggtgctattgagaaagggtatgacaaagaggttgctagtgaaatttttgaacttttaaagcccttttcggggtatggatttaataaatcgcatgcagcagcatattctttaatagcgtatcaaactgcttatcttaaggctaattatcctcagtattttatggctgctaacttgacaaatgaaattaataataatgataagctttcttattatatcgaggagtcaaaagctataggtataaatgtgctcaagcctgatataaatcgatcatttaaagaatttcgtgtaactgattctggaatttcctatgggcttaatgcgattaaaaatcttggagaaattgttgttgatttaataattgatgagagagaaaaaaacggcaaatatagttcttttgagaattttatcagacgtgtagacgataaagtaattaataagaaatttttagaatctgcaataaaatctggactttttgacagtttggatcaaaatagaaaaactttatttgaaaatcttgatcgtttgattgaagttgtttcagaagataaaaataataaaaaacttggtcaaaatagtttgtttgatgtccttaaaggtcaaaacccaatccatcaaaatttcaattatcaggctttcaaagaatattcttattctgagcttttagaatttgaaaaagagcttttaggattttatgtctcgggccatcctcttgatccttataaaaaggcaattaatagtttttccagtttaaatgttttaaaagatcttgctaccaaaaaagatagcattgttcaattttctggcattttaaattcagtaaaagttattcaaaccaaaagaaataatgcaaaaatggcttttggagtcattgaagattttaaaggtgcaatagatattgtagtttttacagaaagctatgaaaggtatagggattttttatttgaaagcaatgttattggggttataggtagacttacgtttaacagagacaaattttcgattgtagttgaaaaagttgtaaatattgagagactctctgaagataaagtaaagaatattcatattaaatttttgaataataaattaaatgacttgcaattacttaattctttaaaggaaagtataagtaattttgaggacaattctggattttcaaatgtttatttttatttaagggaaaatggcaaggatttaaaattaaaaatgaattcaattttgaattttgtgccagatgaagacaagcttgataaattgaggcggtgtatgatagttgaagatgtttgggttgat

SEQ ID NO: 559 - DNA, 792 bp, Borrelia garinii
atgaacaattttttaagaaaattttttctttttttattagttttttcaaacggctatgttgctttttctaaaaacatcaatgttttaatagtaactgccatggattctgagctcgaagagataaacaagctgatgtctaataaggaagaaatagtacttaaggaatatggtcttaataaaaagattgtaaagggtaagttgtctaatcgcaatgttatggctattgtttgtggggttggcaaggttaatgcaggtgtgtggactagctatattttgtcaaaatacaatatcagtcatgtaattaattatggagttgctggtggcgttattagtgataaatacaaagatattaaagtgggagatatagtagtgtcttcagagattgcatatcatgatgttgatttaactaaatttggttataagatgggacagcttatgggattacctcaaaaatttattgccaataaaaatttggttaacaaagctaaagaggccgttaaattaaaggttagaggctctaatgcatattcaggattaatattaacaggagatcagtttattgacccaatttatatcaaaaaaattataagagactttaaagatgtaatagctgttgagatggaaggtgcagcaatagggcatgttgctcatatgttgaatgtaccttttgtagttattaggtccatatctgacattgtaaataaagaagaaaatgaggttgaatatagtaaatttttaaaattagcttcttttaattcagctaaagttgtacaagaaattttaagaattctt

SEQ ID NO: 560 - DNA, 1863 bp, Borrelia garinii
atgaaaaatcatattttatataaattaattatatttttaactacatctgtagcaatatttgcagcagcagataaattaaaggaagaagatatatttaaaataaatccatggatacctacatttggaattgaaaacacaagtgagttcagacttgatatggatgagcttgttcctggatttgaaaacaaaagcaaaattactattaaacttaaaccatttgaagttaatcccgaattaggcaaagacgatccattctcagcttacattaaggtagaagatcttgcattaaaagcggaaggtaaaaaaggtgatccatttcaaattgacataggagacataacagcccaaattaatatatacgatttttttattaagataagcactatgacagattttgactttaataaagaatctttatttagttttgcgcctatgaccggattcaaaagcacttactacggatttccaagcaaagacagaatagtaagaggaacaattcttgcaagaggtacttctaaaaacataggaacaattcaaatgggatacaaactcccacaaatagaccttacatttgcaatagggggaacaggaacaggtaacagaaatcaagagaatgacaaagacactccatacaataaaacctataaaggaatactttatggggttcaagcaacatggaagccaattaaaaatctacttgataaaaacgaagataatcgatctgtaattgcagaaacaccttttgaattaaattttggcttatcaggagcttatggaaatgaaacattcaataattcatcaataacatactctttgaaagataaatctgtagttggtaacgatttattgagtccaactttatcaaattctgcaattttagcatcttttggagctcaatataagcttggattaacaaaaatcaacaataaagatatctatcttattttacaaatgggtaccgattttggaatagatcctttcgcaagcgatttttctgtatttggacacatctcaaaagcagcaaattttaaaaaaggaatatccgcagatcctagtaaaaaaaccgaagatatatttgatccaaatggcaatgctcttaatttcagtaaaaatacagagctgggcattgcattttcaacaggagcaagcatagggcttctttggaataaagacgacggtgaaaaagaatcttggaaggttaagggagctgattcctacagtacaagactatttggagaacaagacaaaaaatctggagttgcattaggaataagctatggacaaaatctttacagatccaaggatacagaaaaaagattaaaaaccatatccgaaaatgcatttcaaagcttaaatgttgaaatctcaagctatgaagacaataaaaaaggacttatgaatggaataggatggataacatctatcggtctttatgatattttaagacaaaaatctgtagaaaactatcccacagcaacaaactcagctactgacacaaacaatcaagccggacaaagttcagaaagcacacaagctacaatccctaatctaacatttgaagacgcaatgaaactcggcatagctttatatcttgattatgcaattccaatagaatccatttcaacagaagcatatgtagtaccttatattggagcataccttttagggccttctaataaaatctcaagcgatgctacaaaaatttatttaaagacaggacttagtcttgaaaaactaataagatttacaacaatttctcttggctgggattcaaataacattatagaacttgctaataaaaatacaaataatgctgccattggtagtgctttcttgcaattcaaaatagcctacagcggaagc

SEQ ID NO: 561 - DNA, 1428 bp, Borrelia garinii
atgagtattgtaattgattcttttaaagagatatcaaaaattccaagatgttcaaaaaatgttaaaggaattattaattttattaaggagagatccaaaaaatttggttattcttttaaagaagatagtgttggaaatcttgttgtgcagataaaatccaatagtaatattaatatgcaccctatcattttacaatctcatgttgatatggtttgtgaaaaaaatgaatccagtttacataattttgaaacagatccaattgaaattgttgaagaggatgggtatctaaaaggagtggggactacccttggagctgataatgggattggagtagctatgatgttgagcattatgagtgaggccaatagcttctctcatcctgatttagaacttctttttaccgttgatgaagaaataggcctaataggtgctcttagtcttgattctaagctatgtagtggcaaaagccttattaatcttgatggggaggaagagggttattttttagttggttgtgcgggatcaagacttgttgagattgttttttctcctcagtatagtcttgcaacaaaaaaaacaaaagtagaaattttgcttaaagggcttaaaggcggccattctggagcagatattcatttagatttggcaaattctttaaaattaatgttttttgctcttttcgaaattaaatcaaatattgattttgagattgaaagtatttttggtggagacagcagtaatgcaattccaaatgaagccaaggctttaatctttattaatgatagtgattatgatttattaagtaaagaacttaaacttttcgtatttaaagttaaaagtgtatattctcttgaggatgaatttgacattgttgttaataaaaaagaattttcatcagttaaagttcttgatgaaaatagcaaaagcaagcttttaaatatgggaatgggatttttacatggagttcaaaaagtagaaaattatgaaaataagctcatcaagacttctttaaatttttcaagtcttttcaaaattaaagacgactatatttttacttttttaataagatctttatttgattcagataaagagtatgtttttaatcatttacaatcaataggcggtttatcaggagctaatttgcgtgtaatttatgactatccttcttggaagtctaacaagaatagtaatcttttaaaacatcttaaagaggtgtataaagagatgtatcttgaagatgctaatgtttctttaatacatgcggggcttgaaacaggtataatatcttcgaggttggggggcatagaatctgttactcttgggccttggattgaatcgcctcatactactagagaaagggtaaatatttcttcaactattagagtttatgatttcttgaaaaaaagtttagaaagatttcaaaaattt

SEQ ID NO: 562 - DNA, 1305 bp, Borrelia garinii
ttggtaaaaatttttatggcaagattaaaaggtcaaaaagtaaaagaatgttctttttgtggacttagcgttgctgagcttgggggcaatgttgttatatctaatggagtagcgatttgtcctgaatgttctaaaatatgtcacaatctttttaaagaaaagttgagcaatccgctagattctaaatccaatggtttgccaactcccaaacaacttaaagatcatttagacatgcatgttgttgggcaagaagatgcaaaaaaagttttgtctgtggctgtttataaccattataagagaatattgaaaaataataaatatgataatggcattgaaattgaaaaatccaatatacttttggttgggcccacaggcagtggtaaaactttgcttgcaaaaacgttagctgcagagatgaatgtgccatttgcaatagcagatgctacgactttaacagaagctggatatgttggtgaagatgtagaaaatattttgcttaaattaatacatgctgctcatggggatgttagtctggctgagaaagggattatttatatagacgaaatagataaaattgctaaaaaaaatgaaaacgtttcaataacaagagatgtttctggagaaggggttcagcaggctttgttaaagataattgagggcactattgctaatgttcccccaagaggtggtagaaagcatccttatgaggatactattgaaattaatactcaaaatatactctttatatgtggtggcgcttttgttgggcttgaaaatattgttaagaatcgaataaacaagagttctattgggttttcagcaattgaaaaaaagaatataagagaggacacttcattaaagtatttagaaatggaagatttgattaaatttggcttgataccagagtttgttggtagacttcctgtacattcgtatcttgaaaagttaaataaagaagatttgatgagaatattagttgatcctcaaaattccattattaagcagtattatcatatgtttaaaatggataatgttgaattggtatttgaaaaagatgctttggaatcaattgtagatgaagctattctaaaaaatactggggcaaggggtcttagatctattttagagggtcttcttaaagatgttatgtttgaggttccttcaattagtaagactaagaaggttattgttacaaaagaatctgttttaaatacagatattaacccattaattttggtgggaaatgcaattaaaaagccttgggcaaaagagttatatgaaatcaatcttaaatatgataaaaaa

SEQ ID NO: 563 - DNA, 2406 bp, Borrelia garinii
atgaaatcaatcttaaatatgataaaaaatagaaaagaagatcttccaattgttattttaaaagaaaatgttcttttccctaatattacattgtgggtaacctttgataatgaatatgtaattaattccatagcccaatctatgttagagggaaggttgattctttttgcatatccaaatgaatctaattatgacgaatttggtaaaggagggattaaaaacctatgttctgtaggcacttattctaaacttatccaggttataaaggtcagtaaagacgtagtaaaagttttggttgagtgtcaaagcagagttcttatagacagtgtttcaaaaaaaaatgattatttaagagccaaagttacttttgtgcctgatgttagtggattaaacagagagctttttacttattctaaatttttaaaagaaacttacgaagtttatagaaattctttatctttaaaatcttatgatagtgataatgagccaattgattattttgagaatccaagcaagcttgttgatattatagcttctaattcaaacttagagaatagtataaaattagagcttttgcaagagttaaatgttaaaaccagaatagaaaagttaattgttaatttaaacattgaaattgaccttttagatcttaaaaaagatattaattctaaagttagagctaagctggataaaggacaaagagattattttctttctgagcaagttaaagagatacaaaaaagattaggtaaagatgagaacgactatattgacagattaaattccaaagatatttcagaagatgttaaatctaagattgaaaaagaaatttctagattatctaaaatgcagatgaattctcccgatgctaatattattagaagctatatagaattaatattagatcttccttggaatgaaaatactcttatgaaaaatcatttaagcgagattgagtttatcttaagaaattctcattatggtatggatgaagcaaaagaaaagataataaattttttagctgtttatcaaattaattctaaggttaaagctcctattttatgccttgtaggacctcccggtattggcaaaacatctcttgtagaatctgttgcaagatcgttgtctagagaatttgttaaaatatctctaggtggcttaagagatgaggcagaaattaggggacacagaagaacctatgttggttctcttccaggtgtttttattagtgcaatgaaaagagcaggcaaatctaatcccgttattcttctcgatgaaatagataaaattaataatagttataaaggaaatcccgaatctgcccttttagaagttttagatcccgagcaaaattataaatttatagatcattatttagaaattccttatgatctttctaatgttttatttgttacaacagccaattctcttaatagtatgtcaaagccacttcttgataggatggaaataattaaagttgagggttattcttatattgaaaagttagagattgctaagatttttttgattccaagcataattaaagagagttttttagacaaagtttatataagaatagaagacgaggttatttttaatttaattagaaagtatactatggaatctggtgtaaggggactaaagagagttttaactaatttaattagaaaactcgtaagggagctgctttataagtattctaaagatcaaatcatcaaaggcaatttttattcaccaagttctttaatacatggaaacaattcactttttactcatgatcctgatattccaggtatttataaaataataaatattaataattattgtaattatgttgatactgagtataacttggatttaattaagattgactcttctggatttgtttatggacttgcttggacaaattatggtggcgcagttcttcctgttgaggcaactaagtttgagaaaacaggagacattattctaacaggaagtcttggggctattatgaaagagagtgcacagcttgcatattctatagttaagacctattcttctaagcttaattttgacataaaagaaagtcccgaaattcatttacactttccagaaggggcaacgccaaaagatggaccttctgcaggtattaccattgcaacagcaattgcttcaatactgtctgacaagaaggtccccttggatcttgcaatgactggtgaggtgactttaaaaggttttgttcttcctgtgggcggcattaaagaaaaagttttagcagcctatagaaatggtataaacaaagttattttacctaaagataataaaaaagattattttaagcttccagaagaagttaaggataatatagatgttaagtttgtctctagtttggaagaagtttttgattatttgaatattatt

SEQ ID NO: 564 - DNA, 2085 bp, Borrelia garinii
ttgttcaaaatactggtattaaggaaaagtaaaactcttggtgttttacaaattataggacttattattttattttatttttcaataataagtcctactaatcttaatgctgattttgagtataaggttgtcaaaggagatactcttttttcaattgcaattaaatataaagctaaattaaatgatcttaaaaggattaataaacttaatgttgacaatattagggtgggtcaaatattaattattccaagtgattctaatttagatcagaacattactcataaagtcaataattcttttaattcgttagaatctgttaagaaaggggtaattctttataccacaaaagagaatgacactgttgagagcgtttcaaagcttgttggaataagccaagaagagataatagcttggaatgatttacgatctaaagaccttaaagttggaatgaagcttgtattaactgagcctgattttttaaagccttatgtagttaaaaaaggcgattcactttcaaaacttgctcaggattttgatattagttctaaggatattttaaaatttaattttcttaatgatgataaattaaagattggccaacgtctttttttaaagaaagcgaccgagagtgttaattttcattatgttaaaaaaggagaaactcttggtagaatagcttatatctatagccttactgctagggatcttgtagctcttaatggcaatcgagctgttaatcttaaagcaggctcattgctaaatgttttaaagattgtaaataatgatttagaaaagccttttgagaaagatttaaaaattgaggaaaaaacaggtaatcagtttatctatcattcagttgctgtgggggaaactttatatagcattgctaggcactatggtgttttaattgaggatcttaaaaattggaataatttaagtagtaacaatattatgcacgatcaaaaattgaaaatttttgataaaaaacttttacttgattcttctataattaaatctaaaaacgattcagatattaaaaacaaagttgattctagcgctaattcttctaataaagttcaaacaatagttaattttccctcaagcaaaaacaaaaagctaaatttaaatacttttggaactactgtcaatcaagatctttttgatattagttctttggttattttagactccaaaataccaatatttgaagttgttggtgatttctattattggtatagacctaaaaagataagtcagccaagtgagttttattcagaagattggcattctcctttaaattcttataaaaaggcgactcaacttttcaaaagttttgaaaagttggtaaattctaggtttaataaaggatcaagacttaaagataagttaataattcttgatcccggacacgggggccttgatcctggagctattgttaaatctagagatggtcttggaaacgaagtttttgttgttgaagatgaatatgtttatgatattgctttaaggctttatgtataccttaaacaagaaggggccaatgttgagcttactattttagcccccgatcatttaattaggaatagtgtttttgctaacaatacttttgttaatgttaaaaatgagatttacaatgattatgacctaaacaaaaatgatactgttgattcctggataagcggtactccatcgggccttaaaaaaagattggtcgttgttaaaaacattgttagtaaatataaaaatattaaagataaggatatagccttttttagtttacatgcagataatagtgttggtgcgcctaagagtatggggttttattatcaaaaagatgacgaaaaaaaatatgatattcattcaaaatctgtagcagaaaaaattacagaaggaatgaaaagaagtttttatattaagggtcaaaatctccatgttttaagaaataatatagtaatgacgaagcttttaatagaagtaagaaatttagcatttccagaggaagcttggtctattaggtcttctaagcttagagatcaagattccaaaattcttgctaatgggattttaaaaatattagaaaataat

SEQ ID NO: 565 - DNA, 1686 bp, Borrelia garinii
atgtttagaaaactaaaaaaatcaaaaacttatattattattatttcaataactaaattttcagagaataacctgttatcaataatatcaaatataaaatatttgattgagcacaaacagctagcttacaaaatacattggacatttccaatatacttttttgaaattctaagagaacatgaggaattaaataaatggctatttgaaagatttaaaaccaataaagatatatatatgccaggaacttacagtggaagccctcatgaatacatgctacacgatgaaatacatttagatttgtattgggcactaaaaaatccatttagaagtggatacaaagatatatttcaaaatacacctattatgctttatatatacaacatagaaaagtttagaaaaaaagtgactgaactttacagaaagcttaatttcaattatacagagggaataaggcagagtaaaaataataaaacttacttaattttttataaaaataactgtcaatatttatatgaagtccaaaaaatagattctcccaaaagcaatgtagaaactcttatttatttttatgaaatcaaagaaagctatgataatcaagaattaaaaaattttttactttatttaaaagccttggaaaataatttgcacagcatcaaaatacaaaatctagaaggatctaaacttactgctgaactgctagaaattccaaaatttaactcccttaaagagcaagagccaataataaattttcaaaacaaaaggcttaaagattatcaaatcaatgaaaaaagcttaagagaatttttaataaataaacaacaagaagaaattgttaaagatttggaatccattgcacctaagaatttggaatataatatggaaggaaattttacactatctcacgatcaatacaatatcaaattcgaaaatggaaagttaaataaaataaaatttaaagataaaaaagttgaatttttaaacacatctagaacctatttaaaagttttatcaaaaaaagaattaataagagaagcatctattgaaagctcattttccttctcaaatgaaaaaattttaggaataaaacaatatttagcttttaactctgccacaaaatcaacaattgatttttttatagatgagactatccctagcttctttttatcaattaaaataaaatggccttccaaaatcaatctggataaaaaaacattaaaaaaatgtaatcctgattatcttcttgaatattcagcccttgaaatacctatttttgaaattgcaaaaggcactaatttaaaaataacagcaaaatacagtgatcttgatacttatgaaaaaataataataactaaaaacaatcccaaaggatacattaatggtacagaatttttaatatctaaaggaaatgataaaaatagtaatttttttataagctttttaaatgttgaaaaacaaatcattcatacaattaattataaaattgaaaaaataaattctaaaaaatggttaattttaaacatagggggttcctataacacagtcaagatccaagatgtaataaattattctcaaacgctaaatttaatgatactgccattaaataataattttgataacaaaataaaactgaattcaaaaataaaaaatttaattttttatactaatataaaaaaatatgaaaataaa

SEQ ID NO: 566 - DNA, 1635 bp, Borrelia garinii
atggctaaagacatatattttaatgaagatgctagaaaaagcttacttagtggcgttgaaaaattatccaatgctgtaaaagtaactcttgggccaaaagggagaaatgttcttattgataaaaagttcggttctccaacggttacaaaagatggggttagcgttgctcgcgagattgagcttgaaaatccgtttgaaaatatgggagcgcagcttttaaaggaagttgctattaaaacaaatgatgttgccggcgatggaacaacaactgctactgttcttgcttatgctattgcaagagaaggccttaagaatgtgtcttcaggaattaatcctattggaataaaaaagggaatagatcatgctgtaaatttagctgctgagaaaattcgtcagtctgcaaagaaaatcacaacaaaagaagagattgcacaagtagcttcaatttctgctaataatgacagttatataggtgaaaaaattgctgaggcaatggataaagttggaaaagatggggttataacagttgaagagtcaaaaacttttgatactacgatttcttatgttgagggtatgcaatttgacagaggatatctttctccttatttttccaccaataaagagaatatgagcgttagctttgatgatgcttttatattaatatatgagaagaaaattagttctattaaagagcttttaccagttcttgagaaagttttaggaacaaataaacctttattaattattgctgaggacattgaaggggatgctcttgccgctcttgttttaaatagcgttagaggagccttgaaagtttgtgcaattaaatcgcctggttttggtgatagacgaaaagcaatgcttgaggatattgcagtgcttaccggtggtgttttaatcagtgaggagctaggtattactcttgagacagttgaaattgagcaacttggacaggctaaaactattaaggttgataaggacaatactactattattaataccggcaataaagagcaaataaaagagcgttcagagcttattaaaaaacaaattgaagattcaacatctgaatatgataaagaaaaacttcaagaacgtcttgcaaagcttgttggcggagttgcggttattaatgttggagctgttactgaagtagagcttaaggaaaaaaaacatagagttgaagatgctctttctgcaactcgcgctgctgttgaagagggtgttgtgcctggtggcggatcaactcttattgaagttgccatgtatttggatacaatagatacaagcaaattaagctatgaggaaaagcaaggttttgagattgtaaaaagaagtcttgaagagccaatgagacagattatttcaaatgctggttttgaaggatctatttatatccatcaaattaaaactgagaaaaaggggcttgggtttgatgcttccagcttcaagtgggtaaatatgattgagagtggaataattgatcctgctaaggttacaagaagcgcgcttcaaaatgctgcttcaattgctgggcttttattaacaacagaatgcgcaatcaccgatattaaagaagagaaaaatacttctggtggcggtggttatcctatggacccgggaatgggaatgatg

SEQ ID NO: 567 - DNA, 744 bp, Borrelia garinii
atgtataaattagttttagtgaggcatggagagagtgaatggaacaaagaaaatctttttactggttggacagatgttaaactttctgacaagggtatcaatgaggctttagaagcaggtttgctcctaaagcaagaaggctattcttttgatattgcttttagttctttattgtcaagggctaatgatactttaaatattattttgcgagaattggggcaatcttatattagtgtaaaaaaaacctggagattaaatgagaggcactatggagctttacaaggtttaaataagtcagaaacagctgcaaaatatggggaaggtaaagttttaatttggagacgcagttatgatgtgcccccaatgtctttagatgagtctgaagatcgtcatccaataaaagatccaagatataaatatattcctaaaagggagcttccttcaacagaatgccttaaagatactgttacaagagttattccttattggactgatgagattgcaaaagaagttcttgggggtaaaaaagttattgttgctgctcatggcaattctttaagagctcttgttaaatatcttgataatttaagcgaagaagatgttttaaagcttaacattcctacgggtattcctttagtttatgaattagataaagatttaaatcctattaaacattactatttaggtgatgaaagtaagattaaaagtgcaatggaatctgttgctagtcaaggaaagttaaag

SEQ ID NO: 568 - DNA, 1023 bp, Borrelia garinii
atgaagatgaaagctaaaagtattttactttttttattatccacggctctttttgctcaagagactgatggattgccagaaggctctaaaagggcagagcctggagaattagttttagattttgcagaacttgcaagagatccaagttcaactaaacttgatcttacaaattatgttgattatgtttattcaggtgcttctggtattgtgaagccggaagatatggttgtagatcttgggataaataattggagtgttttgcttactccttctgcgaggttgcaggcttacgttaaaaattcagttgttgcgcctgctgttgtcaagagcgagtcaaaaagatatgcaggcgacactattttaggagtaagagttttgtttccaagctattctcaatcatctgctatgattatgccaccatttaaaattcctttttattcaggagaaagtggtaatcaattcttaggcaaaggtcttattgataacattaaaactatgaaagagattaaagtagcagtttatagtttaggatatgaaatagatcttgaagttttatttgaagatatgaatggcatggagtatgcttattccttagggactttaaagtttaaagggtgggctgatttaatttggtcaaatcctaactatattcccaatatatcatctagaataattaaggacgatgttccaaattatcctcttgcttcaagtaaaatgagatttaaggcttttagagtttcaaaatcacatagttcaaaagagcaaaatttcatcttttatgttaaagatttgagagttctttatgataagttgagtgtttcaatagattctgatattgatagtgaatctgtgtttaaagtttatgagactagcggaactgaatctcttcgtaaattaaaggcacatgaaacttttaaaagagttttaaagcttcgagaaaaaatttctatgcccgaagggtctttccaaaactttatagaaaaggttgagagtgaaaaacctgaagaatcatccccaaaaaag

SEQ ID NO: 569 - DNA, 1401 bp, Borrelia garinii
gtgcagataaaagaaatttattttggacctaaaattttagacgataaaaattgtaattctaaattgaccaattttgattttaaggttgtttcttttgagcttggaccagatcattatttggtagacattatgcaagttaaagaaattagaaaatctagtaattttacttatgtgccaaatgtcaaaaaatatgtagctgggcttgataatttacgaggcgaaataattcctattatagaccttagaataatgtttaatttagaatttaataaaaaagatcttgaagatattatggttttaaaaaatgaagaccttcttataggggttattgttgataaaattaataatgttttttcaatagattctagtcttattcaagatccacacccagttttatctcaagattctttaataaactatataaaaggcgttgtagattataacgaaaaactttatatactcctcgatgtttttaaaatttttaattatagtgaagaagaaaaggtattaaagcctggccaaaattctgctgaaaaaatcgattttgtaagcgattctgatgatttagatgtgctagatgattgcaaaggtaattttgtcaccaataatgtttttccaaaaaatagtaataacaatgaaaattcaactttaaagaatatttcaacttttaatttggagaatattaaaaaaaatcttttgaaatacgagtttaatgcttctttagtaaatgatgtgtttttagaaaaagttggagtaaaatttaatatggttgatactgattgcttgccttacgatatttttttaaatgaattttattcaaaatcatcgggaagtttgtggggagttgattgtttggaagaatttcaaaatgaaattgttaagaatcgcttaaattttatggataatttgaattctatttttaacgtgttggaaattggttgtggtagcggaagagagactatagccttagttaatgctttgtctgaatattatgtaaaaccttttaagttgacagctattgataatgatttgtcaaaagtggttgaaacttctaggttgattttttcagagtcagaaattggtattagtgaaatttatcgtaggaactcttttgaacaaagtcctggggtttataaatttaagtcagaaattcttaataatgtcttgtttgaatattccgatgctcttttttcagatttgcctgataatttgggaatggtttttttaaaagatgttttatgtttcttggatagtaaagatcagattttaattttaaatatcattgcttccaaaactattaaaggggctcttttggttttgggagataacgaagagcttaaaaataatgatgtttttataaaagagaaatccgcaaaatattttaacttatacaggaaagtc

SEQ ID NO: 570 - DNA, 2259 bp, Borrelia garinii
atgcttgtgaagcttaaatacaggtttgttggatttttattattgtttttaatttttatactgttgcttttttctatgatttttaattttgttttatgtggttatttagaagattattataagcagcttacaagggcgcaattaagaagagcagctttttctacgcaatcttttttagacactttgtatgttataatcaacggtgcagcttctaatttagcacttgaaaccatatcagaatttgcaatttccgagaatagaggaaaagatttctctgagtctgaattggtagatttaagaaaaaattcaaaatttgttattgattctgtaaaggtgaataaaaaatatcgacaatacttatacaattttatgactaatcttaaaaatgatactctttttgaagaattcgcgttttttgattttgaagggagaataattgttagcacaaggcatgaaaataatatggattttggacattctgaggccaatactaattattttaaaaaagcgattgaggattataagcaaaaccaattaaaatttataggctggtattcaaatctttctgaaggaatatctgcagaagttgccattaggtctaggcaaagtgaaaaaaaggcttttgcaataattgtgcctgtatactccccagaagataagcttgtttgtggatatttggctggatatttgcttaatgatgttttagcagatagttttgatagatttagatttggtttttataaaaggggcaattttgtttatatagattctaataatatagcagttaatccttttgaagaatacaatgaaaccagtagggttagttctaaatttttaaatattcttaaagatgttttttctaagccacctcttttatcaaatattcctactgaagtgtcggtttacactattgataggatattattctccgaaatgggagaagagtgttattatgcattgttgcccataagtagtaaattaggagagaaaggtggggtgcttattgctagacttccttataaagatatttacggagtaatatctagtctaaaatttcagtatatcttgtattctgttttaggcattatttcattaagcattgttcttttaatgagaatagataggattattagttttcgtttaaacgcaattagagttttagttcaagatatggtcaagggagatttagacaaagattatgcccttgatgatggtgatgattattttgatgagcttggcatgttaagtcttcaggttgtgaaaatgaaaaaagctatttctgtagcaattgctagtgttttgagaaatattagctatgtaaataaggcaagtttagaagttgccagttctagtcaaaatttaacttctagtgcgttacagcaggcatctgctcttgaagaaatgtcagccaatgttgagcaaatagcgtcaggtgttaatatgagcgctaataattcttatgaaactgagcaaatagctttaaagaccaatgaaaattctcagataggtggtaaagctgttgaagaatctgttattgctatgcaagatattgtagagaaagttagcgttattgaagaaatagctagaaaaaccaatttacttgctttgaatgctgctattgaagctgcaagagcaggtgatgaaggaaagggatttgctgttgtggctagtgagattagaaagttggctgatcttagcaaaatttcggctcttgagattggagagttggttgaagataactctaaggtagcaaccgaagctggagtgatcttcaaagaaatgttacctgaaatagaagaaacagctaatcttgtcaaaaaaatttcagaaggtagctctaagcagagcgatcaaattgctcaatttaaaatggctttagaccaggttggagaagttgttcagtcttcagcttcaagtagtgagcaactttctagcatgtctgataaaatgttagaaaagtctaaggaactcagaaaatctgtattatttttcaaaattaaagattctaagattgaaaatctggaagatggtgattatgatttcaggttgatggattgtcctgaaaattcttttaaagatgaaaatcaagatttgaaaggaaatgaaatctctactttaaatggcagtagacatagtaattattctttaagtattgaaagcgagccttctgcaagaactattaataagcgggttgatcctaaaaaagctatcgatattgctgataaggatttaaattttgatgatgatttttcagagttt

SEQ ID NO: 571 - DNA, 951 bp, Borrelia garinii
atggatttgattagtttttctgtgcctggaaatttgcttttaatgggggaatatactattttagaggaaaatggattggggttggcaattgccatcaataagagagcatttttttctttcaaaaaaagcgattcttggcgtttctttagcaaaaagaaagagatagatgatttttctttaatagaaaatagaaatgatcttgtttttaaaatgttttcatatttgagtcaaaattgttttttaaatttagagagttttgcatatgatgtttatattgatacaagtaattttttctttaatgatggaactaaaaagggatttggatcaagtgctgttgttgctattggtatagcgtgtggacttttttttatttataatgctactaatgttgttgagaaagatgaaatttttaaatattgtttagaagcttacaggcacgctcaaggaggaataggtagtgggtatgatattgctactagtatttttggaggtgttattgagtttgaaggcggttttactcctaaatacagacaactaggttctttagagtttgatgatttttatttaatgcggggtttgcaagcagttaaaaccactgcttctatttatgagtacaataaacatagagattctattttagattttatatttaaatgcaattcggagatgaaaaaacttgttttaagtgttagcacttctaaatctgcattaatttctagtttaagaagagctaaggaattgggattggcaatcggagaggcaataggaatttctgcagccttgcccccaagttttgagcaccttcaggatcaatgtgatttgattaaggctttgggagctggaaatgaaacttttttagtttttaggcctaatattaaagcttttgatttgtcaaaaattattccaattgttctagagcacgaaaacattaagtttgaaagcgagaaatgc

SEQ ID NO: 572 - DNA, 1779 bp, Borrelia garinii
atggagtatttacaaactgcagcttcaattaaagctaaatttgatattgtagctattgtggagcaatatattaagcttgctaaatcgggatctacttataaagggctgtgtccttttcatgccgagaaaaccccttctttttttgtaaattctttgcaaggatatttttattgttttggatgtaaaaagggtggggatgttattggatttttaatggatatggaaaaaatcaattacaatgatgctcttaagattttatgtgaaaaatttggtatttattataatgatttaaaaataaatcgaaaaagtgaaaaaaaaagtgaaaataaagacatggtttcaaaaatttactctttaaactctagattaatcaatactattaaattttttttgaataaaaataaaaaagcattagattacgttttaaagagtagagcaatatctaaggaagtcgttgatttatttgaacttggttatttgccgtttagtattaaagatggcttagaacttcatgattttttagtttcaaaaggatactcttctgaaatactaaggaaaagtggtttattctcaaaaacaaatcccaaagcttctattttatctcaaagattaatttttccaattaaagattttaaaggaaatgttgttggctttgggggccgagatttagatgggaaaggctctaagtatattaatttaagtgaaactgaagtttttaaaaaaaaggagcttctttatggattttatgagggtcttaatgagattaaatctacaaagtcagttatattagtagaaggatatatagatgttcttgccttttttacatctgggattaagagagctgtatctacccttggcacttctttttcaaaagaacatctggctttgattcaaagatatgccaatgaggtaatattttcttttgacggggatgatgctggactttctgcaactttaaaggcttatcaaatttgtttgccatttaatattaatgttagtgttgttaaaatggattttggccttgatcctgcggatcttcttaaagataaaggtgagggatctttacaaaaaattttaaataataaatgcgatgcttttgaatatctcttagatgcttattctaataaatatgatttaaataaaactgtagatttaaatgctatgattaatttatttttaaatttgataaatttatctaaaatagatactcaaaaaaaaatttttttagataagctaagcaataagcttggtgttggtgtaacaactttattgaaagattattatagaataaaagaaagatttgtagttgacaataataaaagaaatttgtatgctcataatgatgattcttatgagaggtatctaatagtagctttgttgaaaaattttagttattttggtataataaggcgcaatattattgatagtgatttaagtgatatcaatgccagaaaaatttttatgtgttttgaggatttatttgaaaataataaagatttttcattaatggatttaaaaagaaatttaaaagatagctataaagttagtgaatttttttttgaagaaattttaaattctggatttgaaatagatgatgaggcgctcattcatattttaattgcaatcaagagaagaaaattagattctcgtgttttgctttgcaagaaaaaaattgatggggactctttggtaaatgctaagattcaaataaatgaattaatgtttttaaatatgcagagaaaaaatttaaaaatctacacagacgatgttccagggagt

SEQ ID NO: 573 - DNA, 675 bp, Borrelia garinii
atgacaaatctaatttttaaagagaataccatatattcaagcaaattcgatgacatctattacaatccaaagtatggaattgaagagagtttttatacatttattaaaggctgcaatctggatttagaattaaaaacaaaagaaaatattttaatagcagagttaggatttggaacaggattaaactttatatgtcttttaaaattcataaaagaaaacaatataacctcaaagattaattattattctatagaaaaatttccactcaaaaaaaagacaataatgcaaatttcaaagttcttcgttaaagaaaccgcttatttcaaattaatgctaaaacattatcctaaaattccaaaaaaaaatttaaaactaaaaataacagaaaatgttaatttaaaaattttaattggaaacgctaaaataaaaatcaaagaaattccaaaaaatgtagaatattggtttttagatggatttagccctaaaaaaaatcctgaaatgtggaacaatgaaatatttaatttaatttctcaaaaaagcagtccgggatgcaagctttcaacattttcttctgcaagaattgtaaaagatggcttaaagcttgccaatttcaaatacattcacatagaaaaaggatttggaaataaaagacatatgataagggcccaaaaaaat

SEQ ID NO: 574 - DNA, 2079 bp, Borrelia garinii
atgaaaaaaatgttactaatctttagtttttttcttatttctttgaatggatttccccttaatgcaagggaagttgataaggaaaaattaaaggactttgttaatatggatcttgagtttgtaaactataaaggtccttatgattctacaaatacatatgaacaaatagtaggtattggtgagtttttagcaagaccattgattaatttcaatagcaactcaagttattatggtaaatattttattaatagatttattgacgatcaagataaaaaagcaagcgttgatgttttttctattagtagtaagtcacagcttgacagtatattgaatttaagaagaattcttacagggtatttgataaagtcttttgattatgaaagatctagtgctgaattaattgccaaggttattacaatacataatgctgtttatagaggtgatttaaattattataaagagttttatattgagtctgctttaaagtctttaactaaagaaaatgcaggtctttctagagtgtacagtcaatgggctggaaagacacaaatatttattcctcttaaaaagaatattttatctggaaaaattgagtctgacattgatattgatagtttggttacagataaggttgtggcagctcttttaagcgaaaatgaagcaggtgttaactttgcaagggatattacagatattcaaggagaaactcataaagcagatcaagataaaattgatattgaattagataatgttcatgaaagtgattccaatataacagaaactattgagaatttaagagatcagcttgaaaaggctacagatgaagagcatagaaaagagattgaaagtcaagttgatgctaaaaagaaacaaaaagaagaactagataaaaaggcaatcgatcttgataaagcccaacaaaaattagatttttctgaagataatttagatattcaaagggatactgttagagagaagattcaagaggatattaacgagattaataaggaaaagaatttaccaaaacctggtgatgtaagttctcctaaagttgataagcagctacaaataaaagagagtctagaagacttgcaggagcagcttaaagaaactagcgatgaaaatcaaaaaagagaaattgaaaagcaaattgaaatcaaaaaaagtgatgaagaacttttaaaaagcaaagatcctaaagcattagatcttaatcgagatttaaattctaaagcttctagtaaagaaaaaattaaaggcaaagaaaaagaaatagtcaaagagaaatcaaaggtaagtttaggtgatttggataatgacgaaacccttatgacgccggaagatcaaaaattatctgaggataaaaaattagatagtaaaaaaaatttaaaacctgtttctgagattgagagagtaaatgaaatttcaaagtctaacaacaatgaggttagcaaatcatcaccattagataagccttcttatagtgatatcgattcaaaagaggttgtagataataaagatgttaatttgcaagaaaccaagcctcaagctaaaagtcaatctacttctttaaatcaagatttgattactatgtctatagattctagtaatcctgtatttttagaggttattgatcctattacaaatttaggaatgcttcaacttattgatttaaatactggtgttagacttaaagaaagcactcagcaaggcattcagcgttatggaatttatgaacgtgaaaaagatttagttgttattaaaatggattcaggaaaagctaagcttcaaatacttaataaacttgagaatttaaaagtgatatcagagtctaattttgagattaataaaaattcatctctttatgttgactctaaaatgattttagtagctgtgaaagatagtggtaatgtttggagattggctaaattttctcctaaaaatttagatgagtttattctttcagagaataaaattttgccttttactagcttttctgtgagaaagaattttatttatttgcaagatgagtttaaaagtcttattactttagatttaaatactttaaagaaagttgaa

SEQ ID NO: 575 - DNA, 1011 bp, Borrelia garinii
atgacaaaaccaaaaatatcctcaatcaataaagaaaaaataaaaatattgacaatattagtgttaacatctacattcttattaggaataattttttcaaatgaaaataaagtagcaagaatcctggaagaaaaatttttcgattttgacttaaatttaatttctaaaatcgaaacagaacttgaaggaacactgacaaaacttggtaaagattggatgctaacatacaacaaacaaaatattcccgttgacaataaaaaagttaatgctctaatcagagcattagacgaacttcaaaaaaataaacttgtaagtagagatcaaaaaaaacacaaagaattgggaattggagaaaatccaagcttcaaattatttgacaataataacaaactattgacagaaatttttgttggaaaaccaggagaaggcgattcaagattggcatacattaaaggtagtagcgaaaatgtttacttaacaaaaaatattttcttatcatataaagggaattcttataatacattttcagatactacactatttcaagaaaaaaacacaaaattagaaaatttatcattcaaaataataagaaaattaaacaaagaaaatgaaaataacataaataataactatgagattaccacgaaagatggtctttattttttaaataaccaaaaaatgttaaaagaaagacctttaaatattattgctgaatttaaagccgatggacttgaaattgataaatctaaaataaatggctataaccttcaatacaagattgaagtcaaatggagcaataaaagtgttaacaatattgaagtttactttaataaaaacgaagaaaatgacaaagacatattaatcaaaaaagataaagatgaatattactacatgactagcaaatggactttttttgatgtatttaacttagaaaaaaaaataatagaaaaagataatatttctagcaatgataatcaagaagatgagcatgaacaccacaacaatgcagat

SEQ ID NO: 576 - DNA, 921 bp, Borrelia garinii
atgataaatgtagaaaaagttaccaaaatgtatggctcatttacagcgctacttaatattaactttaaggtggaagaaggcgaagtgcttggcatacttggcccaaacggagccggaaagtccacattaatcaaaatcttaacatcatttcattatccaagtaaaggtaatgtaaaaatttttggaaaagacattgtagagcattcaaaagaaatattacaacaaataggatatgttcctgaaaaactagctctttatccagaactttctgttaaagaatatttaaagttcatatcagaaataaaaggtgttaaaaaaataaaaaaagaaattgacaaggtaataagcatatttaaattaaaagaagttgaagataagctgatttctcaactttcaaaaggatttaagcaaagagtaggaatagctggtgctttaataaataatcctaagcttgtaatacttgatgaaccaacaaatggtcttgacccaaatcaaataattgaatttaaagaattcttaagagaactcacaaaagaaagtacaatattattctcttcacacatactaagcgaagtagaatctatttgtaaaagaataattattgtcaacaacggagtaattgttgctgatgacacaaaagaaaatattattaaaaataaacttaaagagatcgaaatagaattaatagttttaaaaaaatctgaaaatgaaaaaaaaattttcaatagtaaaaacgatatttttacattaatacaacttgaagaacacgagaaggacttaaatatttcattaaaactatctcaaggcaaaacagaagaagatctctttagctacatagtaaaaaataatataatcttaaaagcaatgatcccaaaacatgaaagtcttgaaacgatatttagcaaattaaccaaggagaga

SEQ ID NO: 577 - DNA, 327 bp, Borrelia garinii
atgaagctaaacgaataccaagaaaaagcaaaaaaaactgctaaatacaaaaataaaaaagaagaattaattttaacaacacttggtcttgctggagaaactggagaagttgttgaaaaaataaaaaaattaggaagagataaaaattacattattgatgatgagtacttaatatcaattaaaaaagagcttggggatgttttatggtacttatcaactttaagtaataatctaggcattacacttgaagatgttgccctaacgaacctaaaaaaaatacaaaagcgtcatgagaatggaacaataaatggtgaaggtgacgacaga

SEQ ID NO: 578 - DNA, 1044 bp, Borrelia garinii
atgacaatacttccaaagattgccaaagacataataaaagcatatgatcaaaaaatattgccaaatgcaattcttttactaggagaaaagttttcatcaaaaaagaccagcgcaattgagattgcaaaaaaaatattaaacgaaaaaaacttaacaaaccctaatttgctcatttttgcaaatctcgatacaatagaagcaaaagcacatctttctacgaattcgtataagataataaataaatacctagaatacattaaaactgtaatttttaccaaatgttatttcagtaatgaaaaaaatttaaaaaaaatagaaaaaaatatcaactacattaattctgtttattataaaaaagaatataatataaacataaaaaatgagtttataaaaaatatagaaaatataaacaaagaactaaatcgtagtattactgtttatgatgtaaaaaaaattcaaacttggattttttctgaaaaagaaaaaccaaaggtaatttacataaacgaaatcgaaaatttatcatttaatgtacacaactcacttttaaaaatactagaagggcctccttcaaatatttactttatcttagcagcaagaaataaaaacaaaataccaaaaacaatactttcaagacttagagtctataatttcacaaaaccagaaaaaagattgggaattcaaatattcaaagaaagctttctaacaaacaaagacataacaattgaggagtatttcgcctcattttacgaagaagaaagcaaaaaaataaaaaaagaattaataaaaattttaaatataataaaggaaaaaaaatccatatttaatcttgaagaaatcgactttataaaagatgatcaaagctttaaaatatttttaaacgaacttacaattaacattagaaaagattttttagaaaacaagatagatattaatcaatatctcaaatacacagaacatttaaaaaatatttataaatatcgcccttataatcaaaataaaaaattaataatagaaaacttgatgctaaattacgaggagata

SEQ ID NO: 579 - DNA, 993 bp, Borrelia garinii
atgaacaaactaatgttaattgcatttgcaacaacaaatctattggcccagacaaacaaagcttcaacagacctaaaagcagaacaatcatttaacgataagttgtctgaaagcgtaaaattaaaagaaattgcaaatatttgtcccacaaatacaaattttttaacaggcattggaatagtagtaggtcttgctggaaaaggagactctttaaaacaaaaagaccttataagtaaaattttaaaagaaaacaatacaatagatgaaataagccctaatagcatagaaagcaaaaatattgcgctagtaagtgtaagcctccaagtaaaaggaaatgccattaagggctcaaaacataaagcttgtattgcatcaatattagactcaaaagatttaacaaatggaatacttttaaaaacaaatcttaaaaataaagagggagaaataatagcaattgcatcaggaattataaagaccaatggcaaattaaaaggatctgaatacaccttggatagtataataataaatgaaaatcaaaatgccagctacagttataatataattcttgaaaaaggaaattatacattaataaatagaattcataaaatattaacctctaaaaaaatcaacaacaaaattaaatcagataacataatagaaatagaagcaaaaaacatgggcctattagaagagattgagaatattaaaatagaaactaatcctaaggtactaatagacaaaaaaaatggtattatcctagcaagtgaaaatgcaaaaataggaacttttacattttctattgaacaagacgatcaaactattttaaacagcaaaactaaaacaacaattcaagtaaactcaatgaaattaaacgaattcatattaaaaaattctaataatcttagcaataaagaattaattcaaataattcaagctgcaaaaaaaatcaataaattagatggagaacttatcttggaggaaattaatggaagc

SEQ ID NO: 580 - DNA, 1182 bp, Borrelia garinii
ttgcgaaaggatttaatttttttagttttaatcgttttaataatagcgagtgtagtaattttttttattagaagctctaaaaaagagctagtttacttcgagcttaatacaaagaacaatattagttttttgtttttagtagaagatcttaataaaaaccttgtaagcatgcaagaaatttttattaatataaaaacaggaaatcttggttttttagatattccaatccatactggatatgaagatttaaaaggcaatatatcttggtttaaagatctttataaaaagaattcttttactaagtttttgtctaaaattcatacgcaattatctcatgaatcagattattatattcgttttcaaaaagaaaattttgttaaacttattgattacttgggaggtgttagacttcttgttaaaaatccagtaaaagtttatagttttgaggattctattttaataccctctggtacttctaattttgatggtgataaagcttatgattatttaagatattttaatgatgttaatcagtttgaagagagagttgagttttttaaagagttttttaaaaaacttctttttcaaatttcagattttggtattgaaaatgacaattttttcaaaatatattccatgatagatactaatctttcagaggttgtttttaagtatatttttaaaaattataaaatcaataatgataaaattatttctattaatattaaagggcaagaagagatttttaaggataatcataataatttgataaaagttgttcttccagaatatgggggcgctattttaaaagaatcggtggataaattgaataaagagttggttaatgaaggcccagaagagatagtaaagattgtcgttttaaatggaacaaaagttgctggacttgcaaaaaaaacagcaaatatttttaattctttaaaatttaaagttttaaattttgacaatgcagataaaaattcttataaaaataccttgattattaataattcggataatttagaaatggctgttagagttggcgaggtaattaaagctacaaatattaagccaatttctgaagttcaaactaaaagattattagagcttgataatcttgatattaatcctgatgtaatagttgttttaggagatgattttaatggaagatatgttaaaagtaaa

SEQ ID NO: 581 - DNA, 1917 bp, Borrelia garinii
atgaatggcaataataatatgaataataatggcaaatctaataataaaaagaagaataaaaattggattttaggatttgttgttatttttttaatttcagcaatatttatgtcatattttataaggggaggggaaagctataaaaatgttccttatagcacttttcagaattatttggacaatggcctagttgagtctgtagtaataattgataaaaatttgattcaattcgttgttaagggttctaactttgcaaaatcttatttttctaccagtatcccttatcttgatataaatctgcttgcagaattaaaaaataaaaaagttgagcttagctcagggaaaagtcaagcttctttgattggggttttattacaaactttaccatggattttattttttattttctttttctttatatttcgtcaaacccaaggtggtggtggaaaagtttttacctttgggaagagcaatgctcaaaagtatgaggctggaaagaataaaatcacctttaaagatgttgccggccaagaagaggttaagcaagagcttcgtgaagttgttgaatttcttaaaaatcccaaaaaatttgaaaaaataggtgcaaaaattcccaaaggagtgcttttagttggctctccgggcactggtaagactttgcttgccaaagccgttgctggagaggctggggttagtttttttcacatgtcaggttcagattttgttgaaatgtttgttggagttggagcaagtcgtgttagagatttatttgataatgctaggaaaaattctccatgcattatttttattgatgagcttgatgctgttggtcgaagtcgtggagcagggcttggtggcgggcatgacgaaagagaacaaactcttaatcaactattggttgaaatggatggatttggaacgcatgttaatgtaatcgttatggctgctacaaatcgtcctgatgttcttgactctgctttgcttaggcctggacgatttgataggcaagtaacagtttctttgcctgatattaaggaaagagaggcgatattaaatattcattcttcaaaaacaaagctttcaaaagatattaatttacaggtaatagcaagagctactcctggggctagtggcgctgatcttgcaaatttaattaatgaaggagccttaatagctgcaaggaataatcaagatgaaattttaatgaaggatatggaagaggctagagataaaatattgatgggagttgcaaaaaaatctatgactattactgataggcaaaagcttgagacggcgtatcatgaggcaggtcatgctttgcttcactattatcttaaacacgccgatccacttcataaggttaccattattccaagaggcagagcacttggcgttgcattttcgcttccaagggaagataggctttcaataaataagcaccaaattcttgataaaataaagatatgttatggtggttatgctagtgagcaaataaatttaggtgttacaacagcgggcgttcaaaatgatttaatgcaagctactagcttagctaaaaaaatggttacagagtggggtatgggtgaagaagttgggccaatatttctagtagatgatgaagcacccatttttcttccaaaagagttttcaaaggctaaggcttattctgagaacactgccgataaagttgacagagaggtaaaaagaatacttgaagaatgtttaaaagaggcatcagatattcttgtaaagcataaggatcaacttgttaagcttgcaaaagaacttgttttgaaggaaactttgacagacaaagaagtgagagaacttttaggttttgaagttagtaaagatgaatgcgatttatttgtagtagagtctattgcaaaagaagtagagggggaagataaaaaaggt

SEQ ID NO: 582 - DNA, 4398 bp, Borrelia garinii
atgaatttggggtttttgagaaataagacatttttattgtttactctaccattttttgtttttgttttaataattttttccattaatctatttgttcaaattcaaatttattctgcaaagttttttgttgtaaaatatcttgaatccaaatttggctttaggattaaatatgataaaatttcaccgtattttttatcatccattaaaatagatggtttggaactaagcttatatggaaaagataaaatcttaatggatgttgttagggtagatttaaatctgtttaaattaattttaggcgatgaaaatattattttaaatgtttatgttaaaggtagtaatttaaattttgatataaacgattttagtatatcgaatgatttaaattctagcagtgcctacgacaatgaaaatgtaattttaaataaaattataaactatctttacagattaaatattaatttagaaaatatcaatattaatattaagcttaataagaataatagttggttgaattttaaagttaaaaatttttccttaagcaccgtagatgaagattttttatttagctctgtagttgattttagtgctgttaaaaatttagaaattaatttaccgtctgaaagagttgatgatggaattttagattcaactttctattttgaggggaaattcaaaaaaggctttgaggatggttatgttaattttagtttttttgagtttaaaacaaaatatttttctttgcttgagcaaggattccaaataaattattcaaaaggaaatttaaaaatttttaatttacgaagagagaattttgattttaatttaagttatgacaaagccaatggttttattcgattagatgctttattttttaatgttaatcttttagattggattaacttaaatgaagactttgaagtttataaagattattttgatataagtttaaatggtcagttggcattttcttatgattttaaagataaagatttaagatatgcaggaataatagattcttctttaaatgtagatactataggcaaagaaattcaaggcttacaacttgaaatcaaaggggatgatagcattgtaagtgttaagaatgctattttaaagcttaaaaggggagttgtaacctataaaggttattattctttaaaagacttgcttccaatagggcgtcttaactttaagtcttcaaaaattttaaactttaatgacctaaatggatatttagatttcaagaaagataaaaatattttttcagttaattctgataattttagtcttgggaatcttaattttcaaaatttaagtttaaaaacttattttctaaaggataaaatttttattgactatttgatttatttggaaaataaaaattctcaaatttctttaaaaggcgatcttaaagatgaggaatttgcttttaatttaggtattaaagagcttcctttgctttttttaaaagaagttattcctagttcttacttaataaatttttttcccaggactttattgtcgggcaaatatttaaatttagtttctgattttaatttaaataaatttgattatcataaaaatagattaaaaacattcaatttcatggtattttcaaagttagataatttcaattttatatttgatgctagtggagaaaaaaatttttacaaatcaaacaactttgagttgcagtacaatgatcacaatttgcattccagtttgtttattgagctatttgaaagtggatttaatattagcacgaatttttcttatttggataaaaattatcctttacattttaatgtcaatcttaaaaacaagcttattattgccgaatctcctcttggcatcaaattcaatttaaattattttgatcctaaaataatttatgcccttaatgttaatggttttaaggtttgcaataaaacttctgatcttttgataaatataaattttaatgggagctatttaggtcttaatgatgatttaaaatttaaaatagataagtttaatatagtaaaagcctctaaaataccctcttataattttaattttggctttaagggtttatatgaatatgataaattgcacattttcgatgttaggcttgtaaacaagctttcaaatttgcaaggatatggacaatttaatttaaaagataatcttaatggaagtttgaatctattttccagcttaaattcagaacgatattttttaggtattaattccgatgaatatggtagttattttttgcttaaattccaagacttagatttttacaattttaattctttgtcccttttagagggaaaggttaatggtaattttttgctaaattttaaaaagaatgatttaaaaaattattctttgagtggatatcttgaggccgataagttaactttattgggcatacctgtacagctttctttaaatttgggattattagataataaacttaacatatatgacataaaagccaagcgcaataaaaaagagtttctcactggtagtctaaggtatgatttaagcagttctataggtgtatctaatatggtttttagtagcaacttgttttcttataagtttaatgcaaattttagaaactttgaaagtagagatgaagagcgatttggagttttgaaaaccaaaatagaaggtgaattctcctttagagatattaaatataaagatgagtttttatccaatcttactgttgaatttagtaatgattttgaaaaatttaacatgacttcaattgattatgatcttattaatgttttataccattatagcagtggagaatatagctttattttaaaagattatttacctcttagttttaattcgtcaggcaaaataattaagaataaaattcttgggaatgtcagagatattaaatttgattcaaaaataatcactaaagattttttagactcacattctttatttaatattgacaatcattttattctttatgatcttgttttaaatggtgaatttgatattgatggggatttatataatcctaatattaatggaattttaaatattcaaaaagggttagtaagtactgagtatttaagagcttctagaaagtttggtggtgatagggctttagaaatatttgatatgccagttgaaattcaggataataaaatcatttttagtaatgagtttaacctagatagatactctaaagtttttgtttctactagcttaaatttaaattttttaagtgatactattattgattattacaaaatagatattagtgtgactggcagaacaggagttcctattaagtttgacaaaattgctttaagctttacaggttatgctttaggcaatttttcaattgaagggaatgccgatgaaattatgtttaaaggaattttaaatatttcaaatgcttgggtttattctcttgaaggttctattgttaatttattagtaaatccctttaagcaaacaaaaagagtgcaaacagttgatgttaatgtcagggattttgatattttgactgatcttgaaataaattttgacagcggtgttacttttcattggccagatagtaatatttcgtttttacaagctactatttcaagaggggataagcttttaataaaatctgatacaaaaaccgatgattttattcttaaaggagatttgaacattgcaagtggtttcgttaattataataataaaaaatttatctttaaaagtggcgcttatatatcttttaatgagagcagagctaaatttgatccatggataaaggctgaggctacaaatactattaaagatagaaatgataaactgcttgttacaataagtattgatagtcctttaagtttatggaaaatcgagtttatgtcttatccttctagaactgaacaggagattaaatatttactctcaggctcaacaatgggtgaggctgaggggggattgcgatcggcagggactaatgctgccgaaatggcaattgggatagtaagtgacattgctcttgattttttaattcaacccattgaagattatatgcgttctgtattaaacttagatttgttgagtataaagacagatatattaaagaattctattaatagtaatttttttaaaattgggaatcctacttttgttgatgttcttgacaatacaagtgttaaggttgggaaatatcttgttgagggtgtttttattagtgggggctttggttttctaaaagagcaaatgactcctttttcaaaggatttaaattttgttattaatttgggcattgagtttgattctccatttttcttggttaattatgagtttgattacaattttatgaaaaaaggtttagatgggataggaaataatataggtatttcttggaaatttaaatat

SEQ ID NO: 583 - DNA, 531 bp, Borrelia garinii
gtgttttttttgattttaccattgttttttttattatcttttaatgttttttcgatagatgttattaaaataggcattgttgattttgatagaattgtgattgaagttttaaatcctcaattgaaagctaatcttgatcaaataaaaaatcgctatcaagaacaaataaatacattaaatttagagcttaagaatttgagacagttgtatgataaatcgattgctgataatgatttagacaatgcaagatcttttggaaaccagtataatttgaaagttgatgagctaaaaagattgtctagtttggcaaagaataatttagaacagcaaagattggctaatattaatagtttaaacaataatagtgaatctttaagtaaaatacttcatggtattcaatatgttgcagagattaatggattttctttaattatgaaaaaaaataatccatatattctttatcataacagcacggttgatataactgatagtgttgttaagtatcttttggaaaaggataataaaaatcct

SEQ ID NO: 584 - DNA, 822 bp, Borrelia garinii
atgttaaaaatattaacaaaaataattgccatttcgtgcctcatggtaggatgcaccagtctgtcttacagccctccaaaacaaaatttaaattacttaatggaacttttgcccgatgcgaatttatatgcccatgtaaatttaattaaaaacagatctatttacaactctttaagtcctaaatataaatccattctagggcttataagcgatttatactttagctataaaaaagaaaataacgactttgctctactaataatgggtaatttcccaaaagatattttctggggaattcataaaaatagaaatatagaatcaatagggaatatatttacaagtccaaaatggaaacttaaaaatttaaacatatatattaccccaaacaaagctagaaccagtattacaataaaccaaaaagataaaaccttaaaagaaaacaatatactaacaacaaaatacattaaggaagtagaaaaaaatgaaatgtttttttggattcaagattcaatattgttgcttccaaaccaaatagcaagtagcaaaaacttaatcccttttagcagtggaactctgtccataaacagcctaaatcaaaaagaatatattttaaaatctttgctcacaacaaataacccatcaatactaaaaatattgtcaaaaaagctaattccaactatcttaacaagcactactaatctcacaatatcaagccacataaaggctacaataaaagaccaaaacacagtagaaatagaatttaatattcaaaaatctagcgttgaaaactttatagcaaaactagcttcaaatattcaaacc

SEQ ID NO: 585 - DNA, 939 bp, Borrelia garinii
atgaaaaaaaatattttggcaacatacatattaatattagtaagtttattatcatgtaatataagtggccctaatgaattaggaaacaaaaaaacagaaaaaaaggggggcggggagggtgttttaggctttatagagaaaattcaagaagagagtataaaaggtgttgaacaacatatagaaaaaagagaaaaacaaacgatgcagacggtttctgtaaaacctgttaatgtaaatagaaattttctatattatcctcaagaagaaatagagataaaagaagaagcgttgattccaagtactgacgaagaaaaaagagtagataaagcaattagcgatgggcgtcttgaatttgataaattagtttatgacgaaaataagcttaaaaatgaatctgagcaattagaatctaattttaataacgtttatgatgaaatctcaaaacttaaagatgcaatacaaacagaggcgcatattgtaggaagaataaaccatataataaaaacaagacctgaaaaaagagaatatcagaatagagtaaggcaaaatcagtcagaaaaacgaactctaattaatttgttcaatcaattattagaaaagagagacgatattgaggaacttcatactcaattagatagcggacttagcgaaagagcatctgcaaaatacttttttgagcaatctcaaaaaactttaaaagatgccattactgagagattaaaaaacgaaaatagaagttggtcaaaaagatcatatggtggtaatttaacaagaaaggcaaatcgtgaaatagataatgctttagagcaattaaaaacttcttcttctaagataattaaagcaatggaaataaagggaaggatagagcaacttcttcaagaagtaaaatccttactggcttcttcaagaagtaaaatccttactggcttcttcaagaag

SEQ ID NO: 586 - DNA, 516 bp, Borrelia garinii
ttgaaacaaaagattattatatttaccatattagcatttctgtttaattgtacaaacaaaaataataatgctgcgctaaataacgatttagatgaagaatctcaaaaattacaatctaaatcaaatttagttaatgacaatagagttgaatttagcaaaacaacacctttagaaaaattaataagcggattaaacttaaacgatgctgaaaaagaaacactagcatttttaataaactcattaaaagaaaagctagcggactcaaatattggtgtaaattttaaaaatactggtggagatgagagtaaaatagaagagactgtacacaaatttttatcggacctaaaagaagatgaaataaaagaaatgcttgcaaaaattaaaaaaaataaagacaaaaaagaaaaaaattctgaagagttaaatacttataaaaacacacttgctggtggatttgatggaatgtttaataaaacagattccaaaaccacatttaataaccttaaagacgctgca

SEQ ID NO: 587 - DNA, 819 bp, Borrelia garinii
ttgactttaatttttggttgttctttagataataattcaaaaatagggaaagagggtggcagacttattggaggaaatgagtcagataggctaggtcaaaaaaaaagggctttagattcaatgaattttaggtcactctcagatggttctagtttagtgtctgattctcaaaatcatgagactttaaaagcgcttgagaataaaaataaaattattgattacagccaaatacagtttttagaaggaacaaaatcaatctctgtgtatttatggcctgttgatattcgttggataaaaattaaagccagagatttgtttaatgagcgcggaaattctattaaagaacttaagggcattaagtattcttatcttgtttctcctgtttctggaagctacatttcttatgccatgcctttaataatttttgagactacttgtgaaagtgatccaatttattctgtttctggatttaaattaataagcaaaggaagcaatataaactttaatgaaaataaaggaggatttctagtgggactcccaatgtctgaaaaatcagttgaatctgggcttgtaactgcatatccttttggttctaacaatgctaaaaaagtagttgaggcctttacctctctttatagtaatggagtttggagcgatatgattgctgagattaccattaagtttaaaaaacctccacaaactgaaaaagtttacagaatttcacttgattctaagctttttaatgttgctatgaaaaaaatagtcgaaaaatatcctcaaattaaaagcgcaagttttgcatttaattcgttgattaac

SEQ ID NO: 588 - DNA, 570 bp, Borrelia garinii
gtgtactcaattgtaaaggaggatcacatggacataaagataaataaaagaaatttatccgagagcattagagaagaagaacaagcacttattcattataataagcttaaagaaaaattaaacatcaattttcaaaaagaaatttattgtaaactagaggcaatgaaggttttaaaagaaattaaagataaggaatattataagttagataactattctacctttgatgattttgcaaaagactatagacttgccagaactcaaacatataagtatcttaaaattgcaacagcaatagaagaaggattaattgaagaaaagtatgtggttaaaaacgggatcaatgaaacaatttatttgcttaaaacaaaagaaggtccgagtttaagaaaatccaaccaaaacccaataaaaccactaagatttcagctcaaaaaggaagaatcttattctttttataaaaaaaatgccaagcttacgagctttcttttggaaaaaattttttttgaggaaaaagattttttattgaaaataattgaagaatttgaaactttaagaagcaaacgaaaa

SEQ ID NO: 589 - DNA, 525 bp, Borrelia garinii
atgactaaatatattaaaaatttacttaaactaactttaattgttgggctgttagtagcatgtagtttaacaggaaaagctagactagaatcatcagttaaagatattacagatgaaatagataaagctataaaagaggctatagcagacggcgtaaaacttaatgagctcgaagagaataaaacaggtgccaaaaaggggggccctcaaataagagacgcaaaaatacgcgtcattaatttatcagtaaaattcctaaaagaaatagaagaggaagctaatatccttaaagataatgtgggaatgaataaagtagataaagatcaattattaaaagacatgtatgacttaatgcttaacgctgcaggatcactacaaaagcttggattgcaagaaatgataaaaacagtcacacaagcagctgaaaaaactcctccaactacagttgaagggatacttatgattgcaaacacaattgaagacaaattaaaaaaaattaaaggaaaacaagagacaaataaaaaa

SEQ ID NO: 590 - DNA, 1584 bp, Borrelia garinii
atgataagaaaaaaaatattacttttaacactactcattgcagctgcaagctcgtgcaaaatttctaaaacaaaagaggatcttgcctttggagttggaattggaaacgaaccatcatcacttgatccacagttttgcagcgataaattgggtaacttaattataaacgagctatttatagggcttttaaggggagatcccaaaacaggtggttacaggccaggacttgctaaaaattgggaaatttctcaagataacacctcttatacattccacttaagagacgacatttattggagtgatggcgttaaaataacagcagatgccattagaggctcatacataatggctttagaggctgaggagaatctcccaaatattaacctcttgacatcaaaaataaaaaatgcaaaagaatttcacacaacaaaattaaattcagatgaagttggaataaaggtgattgatgaaaaaaccttggaaataactcttgaacagccaacagaatatttccttgatatgattacaaatccaatatttatacctattcctactcacgttgttaaaaagtttggaaataaatggacaaccccagaaaacatggttacaagcgggcctttcaaactaaaaagaagaatattaaacgaagaaatttctcttgaaaaaaataaaaaattttatgatgccaaaaatgttgatattaatgagcttacatttgttactataaacgatgcccgcagaatttacagcatgtatgaacacaacgaaatagatgctatttttaacaacattccgttaaatcttattaatgagcttattttaagagaagatttttattcatctgacattaaccaaattggttttctttcattaaacctaaatgctaaaccccttaacaacccaaaagtaagagaagcattatctctagcggttgacagagaaacattggtttacagagtgcttgataacaactttaaagcaacaagaaaggtaagtcctaacattaataattataattatggaaaaaaattaaaaccatataacccacgaaaggcagaaaaacttttggccgaggctggatatcctgatgggaaaaaatttccgactattacaataaaatatagtaaaaatgaacttggaaaggaagttgccaattttattcaaagccaatggaaaaaagttttaaatattaatgtagaagtcgagactgaaacatggtctagccacgtatcaaatattctaaaaggacagtatgagatctcagtaagatcctggcaaggagattatttagatcccatgacattctttactatatttgaaactaaaaactcacatctttcagcttacggatattcaaatcctgaggttgacgaactcttaaataaatctgagtttgaagtcgacaaaaaaatcagattagaaatatttaaaaaagttgaagaaataattattgaaaatgatcatccaataattccaatatacagtgttgcagggaactatcttttcagaaatgataaatggacagggtggaacacaaatgcttcagaaagatttgccctatcagaaatcaaacctttggaagaa

SEQ ID NO: 591 - DNA, 681 bp, Borrelia garinii
atgaaaagaataagtattttatcaatactactgttattattgttgttttcttgtaaacagtatggtgatgttaaatcattaacagaagttgctactgatcttgaggatgacaattcttttgcttctgggagtgtagagtctaaagatcaaattatcgaaaaaggacccgttttaacatcagaggagtttgaaaggttagaggctttaaaaacctttttaaaagacgcaatgggtgttaatggtagagaaggcgatacaaaagctgagtatgagaaatcctataaagaattttttgattggctttctaaggatgttaacagacagaaagagtttgtaagtttttttaacaatatttgtggcattattactaaagcagtggatgcaagcaaaaaaaggtataatagtaatccaaaatccttaggttttaatgaatatgtttgttatgatattaaaaccaggactggggatgatttaagtttatttttccaaaaagtagctgatgcatttggcactcaagagtacaaaaataaagatgaggatgatgagaacaatcaaaagcctgaaaaatgcaatgaagagatttttaaagtaattaaaagagtgtttactgaaagcgagaataataacgaattggcaaatttaaaaaatttaaatagttataatttaaatagtaataataaa

SEQ ID NO: 592 - DNA, 1137 bp, Borrelia garinii
atgaacgcgaatgataaaaacaaagccttaaatgaatataacttaaaaaatatttcagaagttattaaaaatagcttacaaattgaattagactttaaaaaagaacttgaagcaaaaacaaatcaaagtatcccccctattttagaaattgaaaaaattgaacctgaaaaacaagaattttccttaaaatctgaatctgaaagcttaattcccctagaaatactagaagaagcaaatgtggtcaaatcagaagaagaaattgcaaaaatacaagaaaaattattgttaatcggagcttctgatgaaataatagtacaagaattagaccccaatattcaaaaatctttaaatccaactacaatagaattcaaaattctaagcaccgccgacgagaaaacaatacttgatccaactgaagaagaaattaatactaatgaaaaagacaaaatttttgatcaaaaaaaagaaaatagcactttaagcggaactgaaaaaactccaatacaaaatcaattccaaaagcatgacgcatctttaggtaaagatggcaacttaataacaaaagaatatgcagaacaagttagaaaatctctagacaaagcactaaatgcaataaagagtttagaaaaatctaaagatcttttaaatcttgatgccgaaaatttactaaaggatccggaaaattctaaaaacaaaacaaacagctcaatctcaaacaatattgataccaagaacatagaaaaaacaaaaaataaattccttgaagagctagaaaaaagtgagcttagttttgaagacactaaagatcccttaggaataagcaccataaaagaagtaatagatgctgccaacaaatggaaagaaaaagaaaactcaagccaaataaactggaacttgggatcaaagtttcatccaaccccaaagctttacaacgaatcggtagctagagagtatgaagttttggctgaaaaattcactaaagtaaaaaatgaatacaaaaacacaaaagaacaactaaaagttcaacctaaattaacagctaacaacctcagcaaaataattgatgcaacaaaagagtttgcaaaccaagtaagaaatttaatcttattggtagaaaataatcaccaaaagccctat

SEQ ID NO: 593 - DNA, 855 bp, Borrelia garinii
atgatttataagatattaacgctatttaaaataaccttgctgttctcatgctctttttattctccatcaaatagcgaagaagcaacaaaggaattgcaatcaaacctcattgctaaaaactttagtattaataaagcagaaaatttgaacaatttacaacaaagccaactttcaaaaactaaaaaggaaaggataattaaaaaatttattcaaagattaaatgaaaatgaagaattaattgaatcaatagaatcaaagattgaaatatctactcaaaaaacaaatcaagatattcaaaaaattgaacctattgatcactttggaataaataaaaacgcattcccggaaaatactggcgcctcaaatattgacttaatgttaaaaaagaatgaggctagaagattattttattcatctctagattatgatgaaaataaaatcaaaaaattaatctcaatactagcaaaaacatcaagctcaagtggctaccattataatattattgacgcatttttttggaaaggatttaaaacccaagaatcattagaaacagttgtcaatcttttaactaaaaacgagctaagacgcctaatattaaactttgaaacaaaaacagtaaaagatattcaagaaaaatttgaaaaactaatgcaaaataaaaatgcttggataaaaatcgtagaagaagttattagcaaatatggaaacaatacagcaagttccagtgttgatagaataattttaggagaaatgataaggcttggatacgaatataaattaaacccagatgaaagtatgcgcattacagagaagatgaaaatactactaaaagcctgttgtgatcacatacactac

SEQ ID NO: 594 - DNA, 1095 bp, Borrelia garinii
atgaaagaaattggaatatctatataccctaatgtaagtcctaaaaataaaattatcgaatatcttgagaaaagtgctcattttggatttactcaagtatttacctctttactctatattaacggaaatgaatttaacatattcaaagaattactgaacattgcaaataaaaacggaatgaagcctattattgacgtaagtcccaaaattttcaaagaattggaaattgatctttcaaatctcagaaattgtccaaaactagattattttaaaaaacttggtgcttgggcaattagattagacaatacatttacaggcattgaagaatcattaatgacttttaacgattctgaccttaagattcaacttaatataagtaatataaataaacatattgacacaataatgtattttaagcctaatataaaaaatttgcttggatgtcataatttttatccccacaaatatacaggactttcaagaactttctttaaagaaacaacgaaaatattcaaacattattcaatcccaacggccgcatttattagttctagcaatgcagaagagtgcgcacgaggaaaagaaaaagaaggtgtgcctacgctagaatcacacaggtctaaagatatagaaacccaggcaaaagatctttttaaagaaggaatagacactgtcctaatttctaattgttttccaagtgaaacagaattaaaaaaagtatcaaaagtaaacagaaatgttttagagctcaaagcagacctaaatccaaaagcaactccagtggaaaaagaaataatacttgagaatttacattttaatagaggagatattaattcttatagaattcgatcaactatgccaagagtgtactacaataataaaaaatttcctgtacattctccaaacgaaatcaaaaaaggagacattttaatagactcttcagaatatttaggttatgcaggagagcttcaaatatcactaaaagataccccaaataatagtcttataaacgtagttgggaagatagtagatgaagaaatatatctgcttgaaaaaatagaaccttgggaaaaattcaaaataatagaaaataaa

SEQ ID NO: 595 - DNA, 1599 bp, Borrelia garinii
atgtttgatatgaaaatgttgataaaaaagttaaaagctatattatttcttaatgcaattttatttatttcttgttttaaggaaaatgatggacacaaattggcgtttaagctaaatattggaagtgaacctgtcactttagatgttcaattaataaacgattctgttggatcaactattgtaagtcaaatgttccttggtattttagatggagatcccagaactggaggatacagaccaggacttgctaaaagctgggatatttctgatgaaggaatagtttatacgtttcatttaagagataatcttgtttggagcgatggaattgctattactgctgagggaataagaaagtcttatcttagaattttagacaaagaaaccggttcatcttttgttaacattattaagtctactataaaaaatgcagaggagtattttgatggtaaggtgaatgaatctgatcttggaattaaagctcttgatgaaaaaactttagaaataacgctaaaatccccaaagccatattttcttgatatgttggtacatcaaacatttgttcctgtaccagtgcacgttattgaaaagtatggacaagagtggacaaatcctgagaatatggttgttagtggtcctttcaaattaaaatctagagttttaaatgaaaaggttgttcttgaaaagaacgataaatattataaatctaaagacgttgttcttgacaatattgtattttttgtcacagataatagcattacagcttataatatgtatttaaatgatgaactagatgcaatttttaataatgttccaccagatttacttaaggatcttaagcttagagacgattattattcaataggcattaattcaacctatttttattctttgaataccaaagtaaaaccgcttgacaatgttacagttagaaaagcgctatctcttgccattgatagaaaaactttaacagagagcgttcttaatgatagttctattcctacaagaagagcaactccagattatattgattactcttacaaaagcaatttaaatttatttgatgctcaaatggcaaaaaagcttttggtagatgcagggtatcctaatggtaaaaatttccctttgttgaaagtaaagtataatgtaaatgatagacagagaaagattgctgaatttattcaaaatcaatggaagaaaaatttaaatattaatgtgcagcttgagagtgaagaatggtcaacatatataaatagtagggtaaatggtaattatgaaataataagggcagggtggttaggagattattctgatcctatgacattcttaagcatctttaaaactgaaaacacgtctttttcatcttatggatattcaaattctgaatatgataaacttttaataaaatcagatcatgaaagaaatatttttaaaagacaggaaattctaaaaaaagcagagacgataataatcgaaagagattttccagctatctttattaatataatttcttctagttatctttttaggaacgataagtggaaaggttgggaaccaaatatttcacaaagatttgatttatctgtaataaggccaattaaa

SEQ ID NO: 596 - DNA, 1212 bp, Borrelia garinii
atgacaaataagataataaaagaggctttaacttttgatgatgtgtctttaattccaagaaaatcatctatattgcctagtgaggttagcttaaaaacacaactgacaaaaaacatatccttaaatataccatttttaagctcagctatggatactgttacagaaagccaaatggcaatagctattgctaaagaaggaggaataggaattatacataaaaatatgtcaatagaggctcaaaaaaaagaaatagaaaaagtaaaaacatacaaagtccaaaaaactattaacatcaataaggatataaacgaacaaacaaccaaaatgcttttagaaaaacaacatctagaagaatctaaaatatacaaaaatgcagaacgtaaagaagatttccctaatgcatgcaaagatttaaatagtaggctaagagtaggcgctgctgtttccattgatattgacaccttagaacgagttgaagagcttgtaaaagcacacgtagatatacttgtaatagactctgctcatgggcattctacaagaataatagagcttgtacaaacaattaaaaacaagtatccaagcttagacctgattgctggaaacatagtaactaaagaagccgcattagatttaatcaatgtaggagcagactgtttaaaagtaggaataggtccgggtagtatatgtacgacaagaatcgttgcgggagttggagttccccaaataacagcaatctgcgatgtttatgaagtttgcaaaaacacaaatatttgcattatagcagatggcggaatcaggttttcaggagatgtggttaaggcaattgcagcgggggctgatagcgtaatgataggcaatctctttgcaggagtaaaagaatctccttcagaagaaataatttataatggtaaaaaattcaaatcctatgttggaatgggttctatttctggtatgaaaagaggctctaaatcaagatattttcaactcgagaacaacgagcctaaaaaattagtccctgagggaattgaaggaatggtcccatattctggaaaattagaggacattttgactcaactaaaaggtggattaatgtctggaatgggttatttaggagcaaacacaatatctgatttaaaaataaattctaagtttgtaaaaataagccattcttcattaaaagaatcccatcctcacgatgttcttaatatacca

SEQ ID NO: 597 - DNA, 621 bp, Borrelia garinii
atgaaaaagaatacattaagtgcgatattaatgactttatttttatttatatcttgtaataattcaggtggggattctgcatctactaatcctgatgagtctgcaaaaggacctaatcttaccgtaataagcaaaaaaattacagattctaatgcatttttactggctgtgaaagaagttgaggctttgctttcatctatagatgaactttctaaagctattggtaaaaaaataaaaaatgatggtactttagataacgaagcaaatcgaaacgaatcattgatagcaggagcttatgaaatatcaaaactaataacacaaaaattaagtgtattgaattcagaagaattaaaggaaaaaattaaagaggctaaggattgttccgaaaaatttactactaagctaaaagatagtcatgcagagcttggtatacaaagcgttcaggatgataatgcaaaaaaagctattttaaaaacacatggaactaaagacaagggtgctaaagaacttgaagagttatttaaatcactagaaagcttgtcaaaagcagcgcaagcagcattaactaattcagttaaagagcttacaaatcctgttgtggcagaaactccaaaaaaacct

SEQ ID NO: 598 - DNA, 204 bp, Borrelia garinii
atgcttaaactggtaaactacttattacttgctttactactatgttgtactaccattgctagcctaccagatgaaccaaaaccaccaattattcaaaccctaggagctttagccaaatatgaagcacaactatcagattatgttatgtatcttgtaatatttttatcaaaaacaaaagtaaaagttaatgatccaaattatcca

SEQ ID NO: 599 - DNA, 3243 bp, Borrelia garinii
atgaaacttgatgaaataataattccgctatcaatgtcgatcagcaacaatcaaaagctggactcaatagcagaaactctaaaaaaaattgccgagcaaaaatttgcaagtctagataatttgaagtcaaaattagaaaaatctactgcatctggatcaaatttggaaaaagctttgaataaaagctcgcagaacgctagtaaaaacttcaagtctcttgcaaattctgtcgattctgtaaattccaaagctagtggtatgaaaagtataggcaaagttctgaaaagtgttgggaaaggcttaggaagtgtaaagaatttggcaaacaaaactggtgaagcattcaaccaaatgttggcagcttttgccccaattattatagctgtaaaggctctacaagcaattggctccacaataagtggaattttcgatggcgctatggatgctcttgatgaatttaacgaagaagtgtcaacgttttctgacatgcttggaaatgaagaacttggaaaatctttagcagaatccatgagggcttttggcgatgaaactctttttactagagacgctattgctaatgctactaagacaatgctttcttatggtgcaactgcgagtgaagttgaagagagaattagaatgtttggggaggcagctggtggaagtagcgaggggcttgagaaattagcagaagtatattctcgtgtagaatctagtaatcaagtaaatttagaagatttgtatgcgcttcgtgacgctggtgttgatattacagacattttagcagaagaagctggtttagctggagaggcattatataaggccgcgagcgatggacaaatagggttcgaagccttaaataaggctctttctaaggctactagcgaaggtggtaaattttacggaaacaccgctaaagaagcaaaaactttatcccaagctcaacaacaaactgctaaaatgagcgaaaagcttttcttagatattgggaaagctttagagccaatgatgattggatttgaaaaagtaaaacagtttcttctggtggcgatcatggttcctttgaccaaagtgactacagcgacaatatacttaactaccaaattgggtgaacttgtggtatatctttccggcaagtggttggaaggtgtaaaaatgtggttcaaggcaatctccacaccctttgtcaaattgtttgaaggaatcaagtacgtattcaacaagctaaaagaacttgcaaaatatgtttctagtgtattcccagagcgtttcaaaagtgcattcgaaccgatcattaaatggtttcaaaaattgctggatatggcgtccaaagcatacgaaaaattcaaaaatattattactttttggaagaaatcaaaaaaggaagaagatactcccagctccgaacccgagagggacaaaaaggttgatccaaatgcaaaaaccgattacaacaaaaagattgagcaagactataagaaattgcaagacgaaatattttttgcccaaagggaaatttacagtaaagtcggcgtggagcgagaaaaagccttaagggagcttgaaaaaaccatcaagaagaaaaaccaaaagtttctaaatacgtactccaaaagatttgatgagttatcggacgagaacaagaaaattttagtcggggttgaaaaagcagtaaacgaattcaataattctaattatgattttgtgaatgagtatcaagaattactaaaagaaaaagaaagtcgtgaaagaaaaatactattaaccctaccccatacagatcaagaaagcgctttacagaaactgaatgacgaaatcaatggaaagaacaaagcgttcgtagaaaaatatggaaaaagcttcgaaactctgaacgagtccaacagaaaaattgtagccgaacttgaaaagaaagttaaggaatttgaaaaagctgctttagatcgatcttttgtcgaggctcaaaaagctctacaaaaaaacatactagccttagagtgggaaacaatgctacttccagcaaaagaaagagcaagtgctgaaaaaaagatggcatccgacattcaagcaatgtacaagaaattcgtggatgagcacaaatcgcaattcgacaatctaaatgaaaccaacagaaacgcactaaaacaaatggctgagaaagctaaagatactgcaaaaagcttatatgacaaatgtttagaaaatctagataaatttacggaatttacaggcaaaattttgaatcaggaagtgggagaaaaagccggttctgaaggctttgattatgctgcagacagtgcaacaaaggggttggttgattttgggaaaaatacgttgaaagctgttggagcatcttttggacctgtgggccaagctattgcagaaattgtcatacaaatcggagagttcctatggggatggttcaagggtgccgaaaaggccagaattaaaaaaattgaagaacaacgagataaagatttagaagaacttgaaaaacgaagcgaaattgaactaaagaagcttgaagagaaatttgatgcagaaattgcaatgagaaaagaaaaattgagtgaattagatgatgaatactctaaagaaatagagtttctaaaacaagcacaaagtaaaggccaaatatctggtgaagaatttcaaaaaagattacacgatgtacaaacagaatataaaacaaaaaaaggcatagaaaccaccaaacttactaaagtcgaagagactaaaaaactagaagtggaacgacaaaataaattttccaaactagaaaccgagcgaataaaagcacaagccgaagttgataaggtaaatactcgtatgtggtcttggtccaagtcttccgatttagaaaaggcacagaaaattttagacgaaatactaaaaagaattgcaacagtaaaatcggccggatctattgaagagataaaacttgctcgtggcggtgcacgatttgtttcaaataaaccgacatatatgccaaactcaggtgtaatgtctagtgaatttggccaacccgaattggtaagaatcactcctgcaccaatagatgaaaatctacgcaaacttgaagctaaaattattgcagaagaaattgccaaattacaaaaaagccaaagcagtacagttgtaaataatttttactataacttcaatgggaatgtgcttgatgctgaaaaattagttagaatgctaaaatcaaaagaacatctaatgacatttcgaatggctgaa

SEQ ID NO: 600 - DNA, 426 bp, Borrelia garinii; identical to SEQ ID NO: 94

SEQ ID NO: 601 - DNA, 1188 bp, Borrelia garinii; identical to SEQ ID NO: 95

SEQ ID NO: 602 - DNA, 780 bp, Borrelia garinii; identical to SEQ ID NO: 96

SEQ ID NO: 603 - DNA, 2622 bp, Borrelia garinii
ttggaagaacaagataatacagtccaaggaattgacttggaaagtccagaaattactggccaaaatccagaaatatcaagtgccaaagaagatacaacacaagattgtacttctttggggtttgacattgtattctacacggatgaaggtcaaatttttgaacttaccccttttgtagatatttcaagcattgtattagaagaaaaaatagtagacccaagcttaaaaacagcatcaagcaatttcagcttcagcgtaagtggcctatcagaagattttttgaatttcttatttttcagaaacgaagatattttcgtaaaagtaagcgacaacaaaaaccccgtatttacaggaattttagaaaaatttttcagcagagatttgttcaatagcaccaaaagtgtatcgttcacggtcaatgactactctagcctactaaagattgcattcgaaaatccagttcaattcccaatcaatttttcaccagactggcttttcgtatacaatcctttggcaaaagagctctcacttgtccacctaataataggaaaaactaaactgaaagaccttattgatgatgatgctagcgaagcaatacttgacaaagtccccgctgtaatcattgattgtggagaaaatgtagaaactattttacaagccttgctttacgaatttggatacgcatacactttctctccaattggtaaactaaaaattcttccaatttggaaaagtgaagtaatcaacagagaaattgaaatttgtactatagatgccgaaagttatgttatgtcaaaaagtagctccagtagctacgattcaactaaagttatttggagagaaggcaaattccaaagcaaagaagaatcaatatccaaaaaacgaccactctactcagcaccaatcaatgttgctggtaatgatggcaaactttacgttgcagttcttcaaaaaggcgtagtgtaccccgactttgcagacaaagtcggcagcagtgtttttcaagaatacgaccctagttggctagacacagtttacaaatgggacttcaaaaggcgtgaagtttggcacgaccactacgccataaatgaacatttagcaataatctcaactcataaccttgaagcaaggtttagtgccgactcctccatcaagcttgaaaataaagaatattttccaacaaaggctaaactttggtttagaaacacttctagtagtcaaggctccaaatatatttaccactttgatatctacggagatgttttctacacaatagctcaaaatgtaattcaaactgacaatgctgatgatttttactctaaaaagtttgaatacacaaccaggttcattttttccgaagaatccgcagtaagactttttgaattcctaacaaacttacgtgtcaaaggacacactattgttaattttaggtcaatgcaaaatctaaacataaccgattttgtcaaacttagacctgacaatattgggattgatcattttttccttatactttcaaaaaaaattactaactttgatctagatatcaagctttacgaatacgaaggaatcacctggggtgactacactcattacgaataccttacaacttcaactaaaatatcagtaagcgactacttgtctggggtcaacaaagttgttattgcaccgtttaattacaatggcgctgaaactttccagttcaaagctgacggattcaaagacgaagatactctaaacaccgcaattgaatttgcaaaacaagcaggacttaacaaaatcaaactcctcaacggagatttttacatttacgatcaagtaaacctaaacaatttggaaatccaaggcaaagacgaagtgacaataagaagtacggggttttcaaaacatatttttacatcagaaaaatcattcaagctttccgggattagcatatgccagcagccattaagcgagctctacattaacggaggcactctaaatcaagaagaattgtcaatgtacctagaagacaaaagctttacacatccccatggtgtagtcttctgctcttcatattcagtaaaagaaaatgccagatcatcagtctatgttacagatgtaaattttgtgtacatcaaagatgtcacatttcgttgtgctctaaacaatgcactgtatttgaaaaaagtaaaaaaaatcctgctagaagatgttgattttgactctgcaaaccaaggtttcgaaatcagtgacgctaaaaatattacgctcgtcaacaccaacatcaaaagcagcaaaaaagaatcggttgcaagcggatacaacattatgatcagggaaagttcttttgaaaacaacaacaatgcactaaaactttcgaatttctcaagcgtaaaaatactagattctcagctcagtaaaaacaaaggtacagcacttcacttagttgacattactatcgcaagactaaacaataatgtttttgtcgaaaacaaagtcggacttgaaaatcattcttttgacttaatcattcaagacacttttttgaaaaacacacttgctcttgatctatcagattcaaaaggaagaataattgatagtagcacttattcagaaaatactaaagacaaacaggaggccgct

SEQ ID NO: 604 - DNA, 255 bp, Borrelia garinii
ttggggaccttaaccgagtacgtttacaagttcttggatgagtggattcagaagaaatacaacgctaaactgggatttactattgagaaggtagatggtcttgaatatatttgtaaggcaaaaagatatgctagtcttaagaagatattaaccaaaatttttaaagattataaagatatatttcttggtaggttgcagaaggctcctggtgttgcggcagttcccggatcgacaggtaaggggcaaggtggaagt

SEQ ID NO: 605 - DNA, 537 bp, Borrelia garinii
atgaaatcagtgttgacaataacaaatgttactgaagaacaaatctataaagaattcttgcggctgggaatggaacaactaatagctcaagatttgtcaaaaagatattatcacaatgagcttacatatagagatttagaaaatttagaaaaacaatttggaataaagattgataatcttgtttctaagattgatagtgtagaaaagaatttaaataccaagattgatagtgtagaaaagaatttagataccaagatagatggtataaaaaacgaatttaatgccaaaatagatggtttaaatattaagatagaaaatctaaatgctaagattaatagcgtagaaaagaatttaaaacaagatatgtctaatttggcacaagatttaaaaaaagatattcaaattaatagcaaattattattggaaaaactcaaggtaagtaacagaataataattcttattacagtattagtagttcctattgctatatctagtatggcaaatattgttatgtcgataattggcagctatctcaaa

SEQ ID NO: 606 - DNA, 3582 bp, Borrelia garinii
atgaaaactaataacattgtaaaaacaaatgatccatatatgtctctttataaaaaactatcaaaagattttataaaaaaagagagtattaataaaccaaaagacttttttattcttataaagaataaactttcttcaatagatgataattcaacagaagcaaatatagagtctttactaagatctatatttgaagaactaaattattcagtagaacaacaaaaagtcggacaaatagaaggagtggagtctagagtagatatactactttttgaaaatgataaatacagggtagattttaataataaattagaagaagctaaaaaaaataatgagcctattctgactaaagatatcttgcttatagcagaagttaagcgcccatcatttagttttaatactaaaaataaagtaaaagaagcagaagatcagctatatagatatctgaatcaatatcaaaaacattatgggatactttcaaatggaaagatatggagattatatgacaaatctaaagtcctttatggagaaaaaagatatattgaatttgatttttctaaaattgaagaaaaagaagaatacaaaaaacaagaatggtttattttattcatctaccttataagaaaagaaagatacctaaagacaagcaatgtaatagagattgaaaaagaagaaatatctaaagaaaaagagataattcaaaaaaccctgagagagatactttatgagaggcccgacgactctatagtatttaaaattgcaaaaaatatatatgacaaagaatttaaagtatcaggcaaagaaattactcagcagattttagctagcatacttgaagaatcaattatttttattttaagaatattttttattgcatatattgaagataatgacatatttaagaaaatattagaagaaaacaagctatacagatcttctatatcttttagatattttttttatgatgaaaatacaaaaaagaaattaggatataaaaaaataataacaattttcaacttgcttgataaaggaagtgatgcaataaagtttcctatatttaatggaggattatttgcagaagacaaggttaaatatttaaataatgaaagtttactaagtattagtgagcttgaagaagtgctagttaaaatacttttctttgaagaaaaaaacattaaagatgaaaaatttgtagagtattcaaagttagatcccaaaagttttggagaattatacgagactctacttgaatatgatctaagaattgcagatactactgttcatcgtattgttgaagacgaggtttatctcattcgtactgaagaagagcttgaaaacaaaaaagtaaacaaagttgctacatactataaaggtaatatttatctcacatctagatcgcttaatagaaagaaaagcggagcatattatactccagatgacttaactgactttatggtcatatcatcaattgaagaacagcttaaaaccaaggcccctttagatataaaaatcattgataattcttgtggatcagggcattttttaatttcttgtttagattacttaacagaaaaagtatggtatcagctagataaatttgaagatgtaaaaaaagagcttgataaagaatatagagctattcttaaagaaagtgaagaatatgatgttcaagatagtataagtaaagaattggtacttaaaaggatgctattaaagaagtgtatttatggtgttgatattaatcccatttcggttgaaattactatgctaagtttatggattaatacctttatttttggaacgccactaagctttattgaacatcatatcaaagtaggaaatgccctgctaggatataccaaagatgaattttttgatattacaaaaaagaaatttgaaggtggattttctttatttaaaaaaagaattaaagaaattacaactattttagaagacagttatcaaaaaattaaaggtattaatgatactactaaagaagatatagaaaaatctaaaaagatatacaaagaatatgaggaaagtgaagatacagataatttaaaaataatattttctttacttaaactttattcattatcttttgacaaatctttaaatatagaatttagtgatattgcaactgtaattagtttaattgaaaatattttaagaaataaaacttctagtgaagataaagaaaaaatagagataattagaaaattaagtagctactataaattttttcactatgggattgagtttccagatattcaagaaggatttgatattgtaattggaaatcctccatgggagaaaattaagtttaatgagtctgaatttttctcaaaacatattcctagttatagaaaactaagcataaaagaacaaaataagataaaagaagaaatacttagtaaagatactcatcctttgaatattgaatacaatgaagaaaaaaacagtataagcactattaataatatttataaatttgattttaaagattatactagtggtggtgatccgaatctttttagatactttgttacatttaatttaaaattaataaaagaaaaaggtaatttaacttatttagtcccttcggctctttttagtgaatctagttctaggtcactaagaaaacatatatttagtaagtataagcttaattatatttaccaatttgaaaacaaaaaaagatttaaagatgtggattctcggtttaaatttgtgatatttcaatttagtaatattaaagaatctacatctagttttaaagcaaaatttatgattcaacatagtgataatattttaaaagaaataactagagatttaaaagacaataaagatgatccttataaaggaattgaattaaatatagaccaaattaaaaaactatctcctactcaagagtcaataatagaatttaaaaataatgaagaatttggcttaatcaacaaaatgtttagtcaattcagtgtttttagtgaagaatatattgattttaaaaaaggcttagacacgagtattaagaatcgtaaatctttattaaaagaatatgataatgaaaactttatatttctttattgtggagctaatattcatcagtttaattcaagattttttgaaaataagaatgcaaaagaaagttctaagtttttctggatagataaagaagatttagaaaaaatattagctgaaaacaatcagcatcaaaccgaaagaatattctatagggcaattgcaagaaatacagatataagaaccatgattagtaccttgtctcctcaaaattgttattgtgtatattcaatgtatataaattatgagaaaacaccaatatctatttataaaaaattgtttattatatctattttaaattcattagcatttgattttttactaagaagatttattgattcaaatgtgctaaaatcatgtttatatcaatgtccaatgcctcagcccgaagaaaaagaaattttaagtaattctttatatctaaatcttgcaaaaaatacttctatactgatagctaaaaatgatccggagaactttaaatatttactttacttagacatt

SEQ ID NO: 607 - DNA, 750 bp, Borrelia garinii
ttgaaaaaaactaaacttaatataattaagcttaatattcttacaacgacattaactttaatttgcatctcatgtgccgttaataaaattgatccggaaccaaaaagcaaaaccaataaaaaagaaaacactaaagaatttaaaaataaatctcaaaatccagatcctttaaagacaaaaaatatagaagatataatctcaaaattaaaagcaattggtaaggacctagaagctcaacagaaacaagaaaagatagaaatagataaaattgctgctgcacaacttgattttctagatacttttaaagttggacctcgtgatcttattgtagaagagaatcaaatgaaaatgaaaagaataatttactcatctttaaattatgaaacagaaaaaataaagatattacaaggaattcttgaaaaacttaaacaaaatcctaaagctcataatatacttggaagctttctttatcacatatcatggggtattcaatttaacatagaagagtgtttaaaaggaataagaaaagcaataacagatgaattacacactctaggccaagaaaaagccgaaaggctactaatgcaaatagaatctagcttaaagctaaaacaaaggtttgcaaaaactttaaaagaaactattgaagattacaataaaaatttagaaaacattcaaaccgatgcggaaaaactagtaaaccacatgaatgaaaattataaagaacatgattctttaaagcccatctat

SEQ ID NO: 608 - DNA, 1062 bp, Borrelia garinii
atgaaagttaaaagtaaatatttagctttgggattactttttagttttataagttgtaatttattcacaagagatgaaattaaagaagaatcccctggcttatttgataagggaaactctattttagagactagtgaggaatctgttaaaaagcctataaataagcaaggcaaaagcaaggtttcaagaaagcaaggcaaaaacaaggtttccagaaaagaaccgtctattcatagtctaaaaaagggactctgttataaaagcaatttattacaaaaaaatgtaacgttagaggaagaaagtttaaaaactgaattattaaaagagcactctaagactagaaaagaaaaaatacaaaaacaacaagatgaacataaagggatgactcaagtaagtttaaattcccttagcggtgaaagtggtgaattggaggagactattgaaagaaatgaaattgatcttactatagattctgatttaaggcaaaagagtgccttacaaaccatttcaggctcaaactctatttcatacactgatgaaatagaggaagaagattatgatcaatattatttagaagaagaatatgatgaatatgattataaggaaataagattaagcaatcgatatcaatcttatctagaaggtgttaaacataatgtagattcagcaattaaaacaattactaagatatatgatacttatacattattttcaacaaagcgaactcaaatgtattctacacgccttgacaaccttgctaaagccaaagctgcagaagaagctacaaagtttacaaaagaagaccttgaaaaaaatttcaagaccttattgaattatattcaagtaagtgtaaaaactgcaacaaattttgtatacataagtgaaacgcatgcaaaaggaaaattagagaacattgaaacagaaataaaaactttaattgcaaagatcaaagaacaatctaatttatacgaagcatataaagcaatagtaaggtcaatcttattaatgagggattctcttaaaaaagtgaaaggtgccattgaaaagaatggcatttggtac

SEQ ID NO: 609 - DNA, 957 bp, Borrelia garinii
atggaattatttgatgaaaattattatgcaaaagcagtagcaaatattataggagaagttaaagatcctattatgtataaatggtttttgcctgatcaaattgaagatgttgatctaaaaatgggctaccagagaactgtaaaatgggacacttttctaaatgccaaccctacaacaattgcaaatgaggttaatactatctcaactattgggtttagttctcaagtggtaagaattaattacttaaagctacagtataaatttaggcacttaaagcaaacggctgaaaaattttatactgcagattcgtatattggagatattaataataatctactaccttttgctcaagcttataagcttgcaagtagtgaaattattaagcttattaatcactttgttctaacagggactgtttcaattcagaaagatggaaaaaatcaaaaacgtctacttcctaatatgtatggactacttaatatgcctgatcaagtaaaagaagaagttacaagtggcgataaggataagatggataaaatatttgaaaaaattgaagcaggactttcaaagttagagctgggggacgaattttctacacctatgatggtaatagttgatcctgcaacttcattgaaattggtaaaaccatatacaatagcacaagctccagtaatgagttgcgaaaaatgggaagatgttttgattcaaaccattaaggctattaataatagagaagatgtttatattgaaacttcaaacttattaaaacatcaaatactcatttacccattaaacccagctcttattaagtttaaacctagcaagtatatgctacctacaccaaacgagcaagttgataaagactcaactgatattgctcattcatacattgattttgttttaggtgggctgcttgctactaagaagactattttgcaagtggacattaaacaaagt

SEQ ID NO: 610 - DNA, 261 bp, Borrelia garinii
atggaatcggtgttagcaacaaatattactgaagagcaaatatataaagagtttcttcgattaggcatggaacaactaatagcaaaagatttatcaaaaagatattatcataatgaacttacatatagagatttagaaaatttagaaaaacaatttggtttaaagtttgataatcttgattttaagattgataccgtaaagaatgagctcaatactaagatagataatgtagagaagattttcaaaatgatatatctattc

SEQ ID NO: 611 - DNA, 555 bp, Borrelia garinii
atgagtgacattacaaaaattaaacaagagtttgataaaaaagttgctgaaattaaggcattaatgaaaaatccccaacaagacaccgggctacttagtaattccgttgattttagagataaaaacctaatttattcaaattccggtggggtttggactagtagtaaagacaagatagaaaactatccagccaaaggatatccctataagcgaggagttaagcttagttttagtgaagatggttcatcagaatttgaagttgaggctggaggtggggatgatttatacggagtatgcactgatatagacgagtttagtggtatagcaacggtaattccaattacaaataattttatgggatatttaacgtttaagaaaaatggaaacggtttaaacccgggggataagctacattttaatcaacatggcgagcttgaaaagactacgggtgctcaaaaaaccgttaatgccatagcactttcaaaagtacataaactaacagaagatttacatatagtacttgctagtgtttttggaaatagagctataaaaggg

SEQ ID NO: 612 - DNA, 777 bp, Borrelia garinii
atgtctgataaagacaaaagacgtcttgaatacaaagaacttgcaaaagaatcaaaagcaaaaagtaaaatgctagcagcctctcaaggaaaaggacttgttgccaaaattgcaataggcagtgctctaggaaatatcattggcaacgctatgagtaaagcagcaggaggacttttaggatttgctaaaaaagcggttgaggaaaaatctaaaacgaatagagcgaaacttctcaacagtgcgttttttgagaaagatgaacggaatacgattatgggaactcttaaggggatgaaaggatttgagcgcgacttagaaaaagaagagtttttaaatcaagcaagtgtctttaagggtactctaagggacttggggatgctaaatctaactaatttaaaaaaagcagtagagttttcagctgcgcttaaatctagtggcgctatgagcggcgaggatgctgtaaaagctgttaatagtctgcttagtggagagggagatgagctttttgatctactaaaaaagtcgggggttggagacaaatatatagaagatgctaaaaaagcttggcaaagtggcgccgaagtagatctagaatctagaattactatgttggttgaaatgtttaaagattttaaatcttttggcattacgaaaaaagcagatacgaaagaagagattgatagcaatttggcctcagctgagcaaactctttcaaacttaaccactactgttttggatccattacttaaattcatcaaaatggtcactggtttatct

SEQ ID NO: 613 - DNA, 1059 bp, Borrelia garinii
atgaatggaaaaatgagaatgtttattatttgtgttgtttttacactgataagttcttgcaagtattatgcaagtagtgaagatttaaaaaatctagaacaaaatgtaaaaggaaaagttaagggatttttagatacaaaagaaagaattgtttcagatgatccaacagtatatgaaatagcagaaaaattaaaagaagaagaattaaagggtaaaaaagaaaataaagaaaatgttaatttagaaaataaagaaaaaaaagaagattctaataagaatgatttaaaagataatgaagatgctaaagtattaaaacccgagcttgagcatatagctttagagaacaaaaaaccaaaattagaaatagcagaaaaaatattaaaaccagaaataccaaaattgccagtagtgccagtagtagtaaaaccagtagttaaagaaaaaacagaagaagagaaagctagagataaagagtatgaagatttaagaagaagaagaatagagcaatatcaaaaacaagaagaagaaagattaaaaagaaaagcagaaagagaagaaaggaaaaaattaagagaatcaagcggaacttttcttgagagagcgactaaaggtaaaattttaacagtaacaaaacaattagacaagataatcagagatatttatagtattaatccaggatcatcctttgaagaaagaatggaagtatctgggaaagaagttgaagataaggttacgggtgctatttatgatgatattaccaataataattcaagtggcaattctatttattctgaatgggagtatgattttgatgaagaaagtttattaaaaagtcttattgaggaattagaaaaagctagaacagcattaaggagtaaaataaaagagggcaatgaaaataaaaatactgtaataattagtgatattaaaggggatttagaaaaaataaaagataaactaaaagaactaaaagaatatcttcaaagtaatgctaataaagaggaaattcagaaacttgtaaagtgttcaattgatccaaatagtgatggttgtcaagag

SEQ ID NO: 614 - DNA, 351 bp, Borrelia garinii
atgaacaatttagcgtacagaacgtataacatagaaagtataaaaaatgaatttttaaacatagggtttagtgaagaggcaatagattttgtttttctttataatgataattataactttgaatatttaaaagagaaaataattgatgtagaaaagaatttgcaaaaagatatatctaatttagacgttaaaatagacaatgtagaaaagaatttaaataccaagatagatagtgtaaataccaaaatagattttgtagaaaaaaatttacaaaaagacatatctattttagatactaagatagacaatgtagaaaagaatttaaatactcagatagataatgtaagtagt

SEQ ID NO: 615 - DNA, 681 bp, Borrelia garinii
atgaataagaaaatgaaaatgtttattatttgtgctgtttttgcgttgataatttcttgcaagaattatgcaactagtaaagatttagaaggggcagtgcaagatttagaaagttcagaacaaaatgtaaaaaaaacagaacaagagataaaaaaacaagttgaaggatttttagaaattctagagacaaaagatttaaacacattagatacaaaagaaattgaaaaacaaattcaagaattaaagaataaaatagaaaaattagattctaaaaaaacttctcttaaaacatattctgagtatgaagaaaaaataaaacaaataaaagaaaaattgaaagataagaaagaacttgaaaaaaaattaaaggaacttgaagatagcttaaaaaagaaaaaaggggagagaaaaagtgctttacaagaggctaagcaaaaatttgaagaatataaaaaacaagtagatacttcaactgggaaaactcaaggcgacaggtctaaaaaccgaggtggtgttggagtgcaagcttggcagtgtgccaatgaattaggtttgggtgtaagttattctaatggcggcagtgacaacagcaatactgatgaattagcaaacaaagttatagatgattctcttaaaaagattgaagaagaacttaagggaatagaagaagataaaaaagaa

SEQ ID NO: 616 - DNA, 432 bp, Borrelia garinii
atgaagattatcaatatattattttgtgtattttttattctactaaacagctgtaattctgataataatgattcttttaataagaataacaatcgagaagtaaaaagcataaaaaaacgtgatttaagcgaaacagaaaaagcaaaatctccagaagaattacttagagaaaaactatctgaagatgaaaaaagacaccttgattggttaaaaaccgctttaactgatgaaggagaatttattaaatttttaggaaatgatgaatctaaaataaaaggcgcgcttaatcatataaaaagtgaacttgataaatgtactggaaagaatgaagatcaccaaaaaaccatttttaaacaagtggttgaaggagcccttaaagagggtatagatagttttgcagatcaagcaagtagtacatgtggtaatggcaat

SEQ ID NO: 617 - DNA, 552 bp, Borrelia garinii
atgaggattttagttggcatttgtataataacattagctttattgagttgttatttgtctgataagcaggaacaagctgttcaaactttttttgagaatttggaaatggaaagttatgataaagggcctgatgagattattactgaaggtaaattttctaatttaagattatatgtggctgaacatcgtttgttagtcgatataaaaaagactataattagtttaaaagatcctaattatcgcgatgtacctccagtgcctgactataatgaggagtattttaataaattctttttagatctaggctctgatcgatctaaagaactgattaagttgtttggtaggttaaaaaatgagcagaataataaatttaaacacggagtttattggctttattcatgtataagggatttatattctccagatattaagtattctggtgaaggaggacatgaatattggtataatgggagagaggtttttatgcctaggcctactattgatcaacaatattttaaagtgaaggaagtaatagaacagtatgctttaaga

SEQ ID NO: 618 - DNA, 333 bp, Borrelia garinii
atgcaaaataacattattagcttagggcttaatttactatcaagcttaactaacatagctaaaactgatacaaacatagatcataactacattaatacttttaacaaagtaatagattttttctacaaaacatatatgagcacactaaaatctatggaaacagccgagtcaacaaaaatattagaagaaatacaagacatattaaaatacaatattgagataatagaggctatttctaataataaaagtaataaaattatctcctcactaaaagtaaaacgcaataaaatcatgagggaatatattagtatccttaaaaggggtgaaaatgct

SEQ ID NO: 619 - DNA, 693 bp, Borrelia garinii
atggaattagtatcaacaaaaaatattactgaagaacaaatatataaagagttccttagactaggaatggagcaactaatagcacaagatttatctaaaagatattaccacaataagcttacgtatagagatttagaaaatttagaaaaacaatttggtttaaagtttgagaatcttgagttcaagattgatactatagaaaagaatttaaatactaagattgatactgtaaaaagtgaacttaataccaagattgatactgtagaaaagaatttgcaaaaagacatagctaacttagatgctaagatcgataccgtagtagaaaagaatttacaaaaagatatagctaatttagacgctaaaattgatactgtagaaaagaatttgcaaaaagacatagctaacttagatgctaagatcgataccgtagaaaagaatttacaaaaagatatagctaatttagacgctaaaattgataatgtagaaaaaaatttgaaacaaaatcttgacgaaaaactaaaaattaataatcaatttttactggaaaaaatagaaattaataatcaattattgtctaaaaatcttgactcaagcaacagattaataactattatgtcaatagtattagtacctattgctatagctattatagggccttttgttttgtcgctaattaatggttttttcaaacag

SEQ ID NO: 620 - DNA, 175 bp, Borrelia garinii
atgaacaatttagcgtacagaacatataacatagaaagtataaaaaatgaatttttaaacatagggtttagtgaagaggcaatagattttgtttttcttcataatgataattataacttcgaatatttaaaagaaaaattgattgatgtagagaagaatttacgaaaagatatat

SEQ ID NO: 621 - DNA, 519 bp, Borrelia garinii
atggagataatattgaacaaaagaaacctagaagtgctaaatgaagccgaagaacattacaagaagttaaagcaaagattaaaatctagttttcaacaagaaatttattataagatggaagttattaagatattaaaagaaataaaagataacgaatattataaattagatggatacagaacatttgaagattttatcaaagattatcatttagcaaggagtcaagcatatgactatttaaaaatagcaaatgcaattaaagacggcattttagaagaagcttatgtaatagaaaatggtgttacaaaaactcttgagttcttaagaaaatcgccaaatgttttgaaaaaatctaaacaaaatccaataaaacccttaagatttcaacttaagagtcaagaaagttacgacttttataaaagtaatgctaaatttactggatatcttttagacaaattatttaataatgaaaaggaaatgattaaaaaaattatgaaggaatataaacaactgaaagga

SEQ ID NO: 622 - DNA, 540 bp, Borrelia garinii
ttggatattaaggtaaacaaaagagatttaagcaataatggaaattatattattgctgatagtgcattaaatcattataattctttaaaagaaaaattaaaaattaattctaaaaaagaaatctattgtaagttagaaactttaaaaattttaaaagaaattaaagataatgaatattataaacttgatgggtataaaagttttgaagctttttctaaagattatagacttgcaagagcacaggtctataattatttaaaaattgctaatgcaatagaagatggggttatacaagaagaatttctaataaaaaatggcatactggaaacgttaattatattaagaaataaagaaagcaaaacaataaaaaagtcaaaacaaaacccgataaaacccttaagatttcagcttaaaaaacaagaaagctacgatttttacaaaaatcatgctaaatttacagcgtttattttggaagaacttcttgaaaatcaaaaggattttcttaacaagcttttaaaaaaatataaacaattaaaagga

SEQ ID NO: 623 - DNA, 369 bp, Borrelia garinii
atgtttagctgtagtggttttttgacacttgaaggcaaagaaagatcgagctttacggataaacaaagaataagtgttttagagactattaaaaaccactataatggcgactctgaaaaaatatctagagttgacaaatattttgatcgattagaggattctcaaagagatgttgttttacaattgttttcggctggatttgactatataaacgctaaagaatcagaacccacagactcagcaaatagaagcgccaatttagctgctttaaaaagtgattttgaatctaagctaaaaaagcttaattacacagaacaggattttgaaaaattagcagacgaccttaataagtttgttgaatcttctaat

SEQ ID NO: 624 - DNA, 390 bp, Borrelia garinii; identical to SEQ ID NO: 118

SEQ ID NO: 625 - DNA, 1164 bp, Borrelia garinii
gtgagtaaaaaagttattattttatcaatatctataatgatatctattttatcattaagttgtgatctgcgaaaagcaaatgctgagagcggagtagacagcattattagttttggaaaaaattattggaacaatttagcttgtaaatatttaagtggatctgaaaaatctatatttaatgcacttcctaagtctaaaaaaagtcaagtacttgattctattttaaaggaaaaaaatggcgaaggtgctaaacaattattgattaattggggtatagatttcgaaatggcaagttctattgctattaacatagataaagaattagtagagctaaagaattctcaagttagattgttagacaaagattcttatgaagtcagtagtactgtggatttaatgattaagtctaatgatgaaaatcatcgtttattaggccagaatgcatattttgacgttgagaatggcagtggagattacaatgtactttatagcgactttagtagttatgatagttcattagatgctgtcatatcttctgattctgatttaaataataatgataatgcaaataagaattatttaagtaaccagaactatacatatcaagaatatactgataaacaagcacaagaaataaaggaaagagttaaaaaatataaaatttttaaagaaaatgtttataagctttcgcaaactttgagacaatctactttttatgctgaggaattaaacacaaaattatctggaattgataataaagaaagtaattttattttaaaagtagaagatataaaagatataataagattaatagcccgcataaaaatgactcaatacacagagttatcaaaaaaaattcttgataagaacttttcaagtatagctaacgatgaagagtcaaaacgctatgctcttctatataaggatactaatagtacttatcttgaagttagaaaaatactcggcaccatcttaagcaagatatcaagtatagtgggaggatttaaggctaatatagtagatattaaggattctgaaaaaataaaaaaagctaaggagcatgctcagggtgtgcttgacatattaaaattaatagactctggggaaaatgtagaagctattttaacaaaagctaaagaggtagaaaatatttcaaataataaa

SEQ ID NO: 626 - DNA, 471 bp, Borrelia garinii
atgaggattttggttggtgtttgtataataatattagctttattgggttgttatttacctaataagcaaaaacaagccgctcaagctttttttgatgagaattcaccacaaagtagtgatatgggttctaatgagattgttactgaaggcatatttgctaatttaaaattatataaggctgaacatcgtttgttgattaatataaaagagactttaatcagtttaaaggatgctaattataacaatgtacctccagtgggtaatcgctataatgaggagaattttaataaattctttttagacttaggttctgagcgatctaaagaacttattaagttgtttggtaggataaaaaatgataggaatttatttgagaaaaaagtttccctgcttttttcttgtatagaagataattcttcaaatgggatcgattttaggcctattaatgcaatatttgaagatggaaaggag

SEQ ID NO: 627 - DNA, 180 bp, Borrelia garinii
ttgctcgatattaaaaaatatctaattttcattctattatcaaaccttattaattgcaatttattcaataagaacaaaaattcagatcaggtaaacaatattattagtagtcttgatactaatcagaaacaagctttcaaattctttaaggacgaaaatctattaatgacggcacactta

SEQ ID NO: 628 - DNA, 203 bp, Borrelia garinii
atgttagagacaaaggtaaatgaaaataatctgtataatgagcttgttagattaggtatgaataaaatattagcaagtgatttagctactagattttatcataatgaaataacaataaaagatttagagattgttaaactagagcttcaaggttttataaaagatgaaattagtattgtaaaagacgaaattaatgctgtaaa

SEQ ID NO: 629 - protein, 656 aa, Borrelia garinii
MNFNRFLMLFLFNFSVLLGSDTTALGHYQKAHEYYLSKRYYDAIDELVEAIKINPNYYEAYKFIASIYYSLKIYTQAQFFIEKAYKMSNEDIEYKILYANILLKNNKIDQAKKIYSEVLVKQRNNINALVGLASIFEQNGLFIAAANYYLSILDYSQNNYSAFEHLIDIYQRLGMHDKIRHLINKVRVNFLSFPDFHKRVAEFYISINNLGLAEKYALNYLALIESSYKDFGVVGAYRLLALVYLHEFKYEDAIESLQKAILVNKDSDELYYLLGYSYLKFGNIEKAILNLERAKNLKKDLEFYSIALEESFFASNFRNFLKNNSNAKISKHYENEGFKAFKSLDLNKALFNAKNSIDIWPDNDSARFLLSKIYKLMNLDIMSYEQLFYLVKQRNSTDSRILDFYDVVSFDVRKSLFYKYGYKSIADFNKLYDDRTVYRMAIFTQSENKFFGANDLILRYAERVLERNLNIEIVNYNFDYNKNRDYLINNFSEGFSYSRNNNLDLFLIFDFKADILKNTATLLVNVFSGKTGIKVSSFSYDVGGVNYLSNALNSFSKDFHDYLPKKGKILQIKNEDALINLGQVNGVLKGDIFLILKEGALNGETRDSNFIVYKRSDILGEILIEDTSDYISRGTIKSSTFLKDYIQEGATVLVKR

SEQ ID NO: 630 - protein, 238 aa, Borrelia garinii
MNLMLITFNEFKTGISLNDTRAEHLVKILKLKDNDKFKFGILGERNIYHCIYKKDKKLFFKKIFKIEESNKLKKLNVLIGMIRPLVARRIIKELASIGIYEIIFFNTELTQKSYLNSKIFKNNDYEKHLIAGAMQGGTTYLPKIKIMKNLKESLKYIEQENFEIKILLEKDSKKKLIDIEQINNATIIVGPERGFTEKEKQLITQYNFSPCSISSNILRTETAIIAASIITASKLINV

SEQ ID NO: 631 - protein, 315 aa, Borrelia garinii
MKIFFVSSSFIALEVFKEILRHYEVVGVLTLPDKPKGRGQKLSQNVIKVEAIAKDIKVFDPLILDNNTLNSIRDLNPDLMLVFSYGKIFKKEFLDIFRMGCINVHPSLLPKYRGVSPIQSAILNGDCVSGITIQSMALEMDSGNILVQKKFKIRSYDTSYDISKLVSSLSPSLVLEALEKISKGFLGIPQKSSEATFCSFLKKELGFIDFNLSSFEIKNRINACNPWPLVRAKLDYSDIIFHRADFWEIDLYKERKVGEIVDFDPERGLFVNTGKGILFLLEVQRPGRRVLDFKSFYNGSRQLIGRVFSSVGGIY

SEQ ID NO: 632 - protein, 350 aa, Borrelia garinii
LNKPKAFGGSFDKKEIQDKIEKYEKEIHQKNFWNDPKRAQEVIKAQSILKNKIDPWEELINKIKDLSDLCEIVENEKDINSLEIEFNVLEKQYKNLLTISYFKEELDINSAFLTIHSGAGGTEACDWVAMLYRMYSRYAERKKYKTELIDLLEAEGGIKSITIEIKGEYAYGLLKSEVGIHRLIRISPFDAAKKRHTSFASVFVDPVIDEKIEIIIKPEDIRIDTYRASGAGGQHVNKTSSAVRITHIETGIVTQSQSDRSQHKNKDMAMKVLKSRLYEYYKNKEDKKNKSKQEVKKEISWGNQIRSYVFQPYNLVKDHRTKFENSNTTSVMDGNIDNFIEEYLKWKSLN

SEQ ID NO: 633 - protein, 342 aa, Borrelia garinii
MKKKQLILLLFITQIIYAKSYFASDTFFNKYQKLNEKPKKGFYIEYHLIDDTEKLYLYKETNLIKYKTIQIIENTRKITYYDTKDTKRKEEVYDNLNNKIQEIEYDSKGKILETANYFYENGNLISKNLKTINQKPKLIFYSKDENGKLLKITGSNFQIWNYGINGDIKSTYFDIKKSTTKAIKYDDKKRNLNSTIIVNNKIKSKEKNQYLDEQKIVNTVEEANTKIISTYQRNNLIKEETYKNNELIKINDFQYNSSDMIIFQNTKEKDKDQYTNTKIEYEYNKDNQLKSKKIYENDIIYLKTEYHNDNEYEEEIYYNKKPALRVKHKNGKIIEEKPIGTN

SEQ ID NO: 634 - protein, 417 aa, Borrelia garinii
MMLLKLTEITKIAYIIFKNSTNKIALIGSGISLSLVMIPLIIVYYMSSNIMTSTINKYIESEGFSIQIEYNNTNKTNYLKDRLSSFKKKYNYKDLNYFFEKRTYGIIGNNKKQGVLIRAIENEFILENKSIKLIKGTKNLKKDSILIPNQIKNKLNLNLNEKIDILIPNAKNHKILPRIKKFHISGIIETGLKDIDNNLVLISLENENLMSKKFSKSIIGIETNFNSIKNNEILKQNLETEFQEFQIKTFYELYLNKYNNLDISKKLLIFIMALIIIFASINISSSISMLIFENKKKIAILKSIGMNNLNIKIIFLLISLTLSTTFCGIGIIIGNYLTLKISYLINFVDNVLNFFLKIFGEENSEILNSEYYVSEFQIDLSLSFSLTLLSLYMLINILTTLVPLNIVSNLKEKEILR

SEQ ID NO: 635 - protein, 144 aa, Borrelia garinii; identical to SEQ ID NO: 394

SEQ ID NO: 636 - protein, 575 aa, Borrelia garinii
MKTKGKVVGVNGNLVTIEVEGSVSMNEVLFIKTAGRNLKAEIIRVRGNEVDAQVFELTKGISVGDVVEFTDKLLTVELGPGLLTQVYDGLQNPLPELAIQCGFFLERGVYLRPLNKDKKWNFKKTAKVGDSVIAGDFLGFVIEGTVHHQIMIPFYKRDSYKIVEIVNDGNYSIDEQIAVIEDDSGMKHSITMSFHWPVKIPITNYKERLIPSEPMLTQTRIIDTFFPVAKGGTFCIPGPFGAGKTVLQQVTSRNADVDIVIIAACGERAGEVVETLKEFPELIDPKTGKSLMDRTCIICNTSSMPVAAREASVYTAITIGEYYRQMGLDILLLADSTSRWAQAMREMSGRLEEIPGEEAFPAYLESVIASFYERAGIVVLNNGDIGSVTVGGSVSPAGGNFEEPVTQATLKVVGAFHGLTRERSDARKFPAISPLESWSKYKGVIDSKKAEYARSFLVKGNEINQMMKVVGEEGISSEDFLIYLKSELLDSCYLQQNSFDSVDAAVSSERQNYMFDIVYNILKTNFEFSDKLQARDFMNELRQNLLDMNLSSFKDYKFNKLEQALSELVNLKKVI

SEQ ID NO: 637 - protein, 397 aa, Borrelia garinii
MKKVAIIDGLRMPNTKFGGSFKGLDIIDESSKVVKALLKRNNLCEVDEVIVGNVISSGLGQNIARQIALKSSLGDNVPAFSVNKVCGSGLKALELAFNSIVLGNNDIVLAGGMEDLTNSPYLLPRKVRFDGLKFGNFGIEDSIQKDALIDSLNFISMGLTAENLSEKYKITREMQDEFAYNSHVKALKARELGYFEDEIHPLTILDKKTNSSRIVSSDEEIRDNLTLNKLASLNPVFKESGTVTAGNSSSLNDGACFLILASEERVKSLGVMPLAYIGGFESVGLSPLYMGFGAYMAIEGIISKLSLNPSEIDLIEVNEAFAAQALSIEKALFKKYNIASDIINVNGGAIALGHPFAVSGSRILLTLARSMKMKNKTKGIASVCVGGGQGISSFLYR

SEQ ID NO: 638 - protein, 551 aa, Borrelia garinii
MENQKDLQENYLKVLERVELGSRVSGTVINIMKDYVLVDIGYKSEGFIKIEEFENVPKIGDKLEAIVVRIGGELGLILSVEKLDSLNFQDKVDEYIQNKKVIKGKVLAELANGYKIQINENVSGFMPFYLSSKSKDEKLKRGLIVEFYILEASESDGLRLILDRRTLERERDLAKRIELVSSYNEEDVVDGVVDRITEYGAIVKIKNFVTGILHKRNIAFNQVENIEDFVRVGDKLKLKIIKINLQTGKMELSLKALKANPWDSVDIKYKIDSIVKGKVVKILPFGAVIELDSELSGFLHISNFSWIRVIKSPQELIKLGQMVEVKILEVDKENQKISLGIKQINENPWERLTEKYPIGKVIQGVVTNITKTGAFVNIEEGIDAYVSKFDISWLEEIDPEEYFKIGDLVNGKVLEVDRRKRNVRLGIKQLEESPWEDFSKSYKKGDAIEVEIVEKKSKGFQVRVYNKIMGFISKIQLGDTKESSLETFEKLNIGDKLKVVITSIDSKDRSVLLSYREYENQKSREEISSYLFKGNDEESYKPFESLLKRDE

SEQ ID NO: 639 - protein, 629 aa, Borrelia garinii
MTKKILNNKYRIKTILIISLGITLLTIYKYFTLMVLNNSPDNIISLKSNDIVRRGTIYDRNGKPIAFSSKSYSIGTNPQKIENIVNTSETLGAILQIDSRILKEKLSSNKGFLYIKRKIKREESDLIKRIQAEGRLSNIALYPDYTRIYPFRHVTSNITGFVGTDNLGLEGIEFSLNSILVKDKTKQQFLNEELETNNIYLTIDMNIQQGVSKIAKKYFKENNPESLITLVMDSQNGEILSMVQFPQYDANFYSEYPEEIRKNLSSSLTYEPGSINKIFTVAIILESGKLNLEEKFLDNGIYQKQFPSGEKITIKTLNPPYKYIDSTEILIYSSNVGIAYITDKVSNEYFYKKLLDFGFGKKVGFPFPGETKGLLNHYSKWSGRSKATIGFGQEIGVSAVQILQAASILGNNGIMLKPRIIKKISNDKEESIKEFDKEEIKRAISKSSAQKVLKMMREVVNKGGIPNLKIKNLDISAKSGTSQAIDRKTGKYSEEDYTSSILAIYPTEQPKYIIYIVYRYPKKIIYGTRIAAPMAKEIIEFIEYQQNTSAYKKIKMPSKIKIPKTAANYKNKAYLPNFINLSKREAIDILKYYKNTIKIKINGAGFVYKQSIPPNTKLEDIVELELYLK

SEQ ID NO: 640 - protein, 336 aa, Borrelia garinii
MIINHNTSAINASRNNSINAANLSKTQEKLSSGYRINRASDDAAGMGVSGKINAQIRGLSQASRNTSKAINFIQTTEGNLNEVEKVLVRMKELAVQSGNGTYSDADRGSIQIEIEQLTDEINRIADQAQYNQMHMLSNKSASQNVRTAEELGMQPAKINTPASLSGSQASWTLRVHVGANQDEAIAVNIYAANVANLFSGEGSQAAQTAPVQEGAQQEGAQQPAPATAPSQGGVNSPVNVTTTVDANTSLAKIENAIRMISDQRANLGAFQNRLESIKDSTEYAIENLKASYAQIKDATMTDEVVASTTNSILTQSAMAMIAQANQVPQYVLSLLR

SEQ ID NO: 641 - protein, 665 aa, Borrelia garinii
MASGFFVPGLESKYNTKEIRESMLKPDRAKIDSSFKKLESLEQEKSAWQLINRKISALNSLAKEITSLNSPFNLMSGNSSNSEVLTLSTRYGSKNETHKLIVDQIASADVFLSSNFDPKKVTIPEGDYIFLVGKKEINVKSNGNIDLLVKDINNKGKGFLSAKIVKSDKNGNSRFILQSLKEGKENKLVIKGEGLSFAKQIGILSELKTNFNPTFSDIVVNQSSSNNRLVFENNSLVLNPLSEVSIEIPEDIEITSRSKIKFKVKYFDTGLEEPDSKIIFNPGEATFKDAKVDSEYSVVDLGSDLKTPLEKKYIQMNMVKICNIEGSLELPSINISNNFEEVEADVGAFSNLQEINIEITANNKVIVISNVEVFDPKNRDGHLPINAKSFAENAKIIFDGVHVERDLNVINDLIPNVTLSLKKASSDMVEAKVEPDYEGIKRVLLDFIGAYNEVIAEINIVSSNEDQLGNQKSNIVEELTYLSESQKEEAYKNLGVLRSEFLLKNLKSRLESIIFKPYVTSDPNFSIINQMGVFTNSISSSGGLSRYLRLDEKKFDESIRNNIDNVRELFLFDLNGDRVYDNGIAKMLGDCLAPLVTSGGVIYNKIKNYDLKIVNQKNKVEDYKKKYDDRERKVEGELNILDFTVKRMKDQENTLKAFDFNQRNR

SEQ ID NO: 642 - protein, 401 aa, Borrelia garinii
MPNFCLFNSKSVLTGNDKLDNSAVLIKDNEIFDIVTSDRLKKMDLREYQMIDAKCNYITPGLYDSHIHGFHGYGTDQCSTESILKMSEHLAQYGVVGFLPTLYPRPIDEMIQTIKACTAAIGKEKGAKILGLHLEGPFFSPEKRGAHPVSYLHEPSIKVMQKLIDAAGGIFTGSNGQKKTHISTMTVAPELKGMRELAMFCLENNINLQAGHTNATYENMIEGFQVGILHTTHFFNAMSKLDHRNPNAIGAVLIHGDVSCEIIADGHHIHPKLVLMMRKLKDISKIVLVTDGLTPNFQTSGKLIANGDEVYIAEDGLFHSVKSNTIAGSTLTMIQGLKNLVEFGYSLSDAVQASSYNPTRILNIDKKGLICHGYDANINVLDKDFNLKLTMIESKIIFNNL

SEQ ID NO: 643 - protein, 627 aa, Borrelia garinii
VDSTFSGIEIGKRSLFAHKDAMNTVGHNLSNATKPGYSRQRVTMKTEIPLYAPQLNRAKKQGQLGQGIVVQSIDRVKDELLNTRIVEESHRLGYWTSQDKFISMLEDVYNEPEDQSIRKRLNDFWESWQDLANQPQGLAERKIILERGKSFCELIRSRFHSLERIYIMANDEIKITTDEANNYIKNIANLNKQISKSQAMKDNPNDLMDARDLMVEKLGNLISVSIENKQDPNEFLIHSEGRHLVQGSIANEFKLEATNGPTRTKWNIFWANNDKANLETGKLGSLLNIRDEEIKNEINELNNLAANIIELVNEIHETGHGMDKKSGRSFFSQELKLTDERGRYDTNGNGQFDSVHIFKINSTNEIFPEEKLGFYGILKFEATNSNEIIEIPYNAPDTVQDLITRINNSNAQVTARINSEGKFEIKAVKEQENENITFRIKHIEDSGLFLTKYTGILNESGPEGAYDYRNIDTIDKLTPKSTYSISPLKNPAAWIKVADIIDLDPSKIAAGINSPTNEISIGDNQAALRISSFGNSQIMIGKNLTLNDYFANTASNIAIKGQISEITKESQSQILKDLTDLRMSISGVNKDEELANMIEFQQAFIAASKFITVSAELIDTIINKMGV

SEQ ID NO: 644 - protein, 246 aa, Borrelia garinii
MSSPKILTIIVLLAILAQGCKEPSIIEKQFNYTIVFSDATEYFFQIQKTPFIKNKILFINDKSLEIIKDKLKTIKKILLTHKSNNEILNNEILKEKIFNLSKIKFSLKKSIDFLLNGKSIDFQKTLLFRDKSLNNEDLEYLEKKGKEKNVNITLINEKNISYIKTFITPQIKTIILFSFRDNNIILKKISNSPFFKNIQFVLIGNTRKDLKIIKLKYVITLKESDLMEIVKDIETDFQYEFNIYKQ

SEQ ID NO: 645 - protein, 361 aa, Borrelia garinii
VKKNLMLIFGGVSFEHEISCKSAYSIYLALLDLNKYNIYPVYIDKCTGIWYLLDSVSDPPKLIDIDVLPIVSLLPGIGIFSNNKNLDIDVVFPVVHGRTGEDGAIQGVLKVMDIPCIGAGIIGSAISSNKYFCKLLLKSFNIPLVPFIGFRQYDYFLDKEEVKRNVREALGYPVIVKPAVLGSSIGINVAYSENQIEFFIEEALKYDLTILIEKFIEAREIECSIIGNEKIKIFSPGEVIVQDFIFYDYDAKYSVIPGNSIIFNIPAQLETNQLLSIKEYAFLVYKNLELRGMARVDFFVEKKSGKIYLNEINTIPGFTDISMFAKMCSHDGLQFKDLVDNLINYAFQSYINRKKRINFED

SEQ ID NO: 646 - protein, 906 aa, Borrelia garinii
MNKKRTNFSVLLLLIFLLILSFGGFGYYIYQSKLNDKNREIMLNEVKNSIIDRNYKKAYSVAKLLQDKYPKNEDIAMLTNTLAEIANSSPFESNELQRDSANQILDKIKGQENAKTNINENFDIAFNNRYIKDSAITENYADRNDDIGIEDEDISEFKKSKIPEKVNQNAKQKEEDQAIQSPNPKLNVNDQKNSFNLEKLKKKLSEKSNSENILKNPQNIENDKQSSNFSKEKNSEHILRNPDNSKYSKNDNATFLKDVPLNSKKESDFSLPSQTIIGKIHRPYSYLIKKELYEILDDINTGRVALGKNRLKKLIKKGLSNKFQKVNELIESLKNKDASNLLLTLIKKDIEPNLINVPNIPKDPYKKDIFQLNKEDKKTQQSEDLKSKIYSIKPTDLENPKNRQQAIKDLNEFLKINPNDTYASKTLAQANKIQQSENLKSKIYSIKPTDLENPKNRQQAIKDLNEFLKINPNDTYASKTLAQANKIQQSENLKSKIYSIKPTDLENPKNRQQAIKDLNEFLKINPNDTYAYKTLAQTYENNGDLLKAENVYEKIAKLTNAQEDYYKLGIIRFKLKKYEHSIGSFDQTIRLDPKHKKAHNNKGIALMMLNKNKKAVESFEKAIQIDKNYDTAYYQKGIAEEKNGDMQQAFTSFKNAYNIDKKLNYALKAGIVSNNLGNFKKSEEYLSFFNDNAKKPNEIAIYNLSIAKFENNKLEESLEIINKALNLNPEKSEYLYLKASINLKNENYQNAISLYSSVIEKNPENTSAYINLAKAYEKLGNKAQAISTLEKIINKNNKLALNNLGILYKKQKNYQKAIEIFEKAIKNSDIEAKYNLATTLIEINDNIRAKDLLKEYTKLKPNNPEALHALGIIEYNENNNDQILRELVKKFPNYKKNENIRKIIGI

SEQ ID NO: 647 - protein, 278 aa, Borrelia garinii
MKKFVILIFMLSVSLLCNCKNQDNEKIVSIGGSTTVSPILDEMILKYNKINNTKVTYDAQGSSVGINGLFNKIYKIAISSRDLTKEEIEQGAKETVFAYDALIFITSPEIKITNITEENLAKILNGKIQNWKQVGGPDAKINFINRDSSSGSYSSIKDLLLNKIFKTHEESQFRQDGIVVKSNGEVIEKTSLTPYSIGYIGLGYAKNSIEKGLNILSVNSTYPTKETINNNKYTIKRNLIIVTNNKYEDKSITQFIDFMTSSTGQDIVEEQGFLGIKT

SEQ ID NO: 648 - protein, 405 aa, Borrelia garinii
MQDPRLSKYKNTKNLSKKTVEEIDTLSLNKNFSDSEIQGSMLRSWISLIKGNKNKAPVESKSDNINNLKPGFIRKESKVIKIAKYFLAIGLEKSAKIMSELDDSDIILITREISKISYIAPEEKDHIIKEFEELIRNEKRYVKVDDNFAYELLNKTLGKSKAKLIYKKVTGNDIFIPFDYLSQIEHEQLWALVKDENIKTLVILYNYLNKDQKKYVFSMLEEEGRREFVKDLAKPRQLSMETIEAISNKLKDRFKMQGRLKTDKLDGSKILVDILSYMDSNEEKSLLNKINMRDLNPVVDSEIREKIFDINVILRIMDNDLHNILREFTDKEIAIIIKDKTDEVRDKMLSNVSKRRKEIILDEEAFLGKISKKDLKAMTSSFVNYIKSLTLKGDLVIYRKNEEFI

SEQ ID NO: 649 - protein, 668 aa, Borrelia garinii
MLIFGFIGLFFLNLFSLNAQGIVTNKDAQEEFKWALNSYNNGIYDDALLSFKKILSFDPNNLDYHFWTGNVYYRLGYVEEALMEWRNLKDQGYKVPYLRHLISTIEQRRGIFSNYELNFKKLVKVASLDNSIYKRPHGYQITSLRADKYGGYYAANFVGNEILYFDVNNNVNALVKDGFSYVKSPYDVVEANNLLYVTLYSSDEIGVYDKVLGVKKRSIGKKGTKDGELLAPQYMAIDKRNYIYVSEWGNKRVSKFGLEGDFILHFGYKTSGYNGLLGPTGITYLNENIYVADSLRNTIEVFDTSGNHLYSIFTSIEGIEGLSSDSAGNNVIISSKYGVYKYNIAKKTITKILKADKVNSKISSSILDANNQMIVSDFNNAKVSVYKSDSSLYDSLNVDVRRIVRLGGPKIYVELNVSSKSGLPVVGLKSENFSIANENYYIVNPKVVYNVNASKDINIAVVFDKSSYMKNYDLDQIVGLNALIESSKNKNFSFINATSVPIIDNIESLTSSIKNTSSLGPYSTDTVKTDVSLKLAGSGLMSKSSRRAVVYFSGGVLNHKAFEKYSLDTIVSYYKNNDIRFYLILFGNDPVNSKLEYLVNETGGAIIPFSSYEGVSKVYDLILEQKTGTYLLEYYYPGPQEPNKYFNLSVEANINQQTGRGEFAYFIN

SEQ ID NO: 650 - protein, 256 aa, Borrelia garinii
MGRLFLLYFLCSFVFLNLFAQGSSSYTDKQKELAIFYYEVGQRYINVGKIKKGKLFQAKALKFYPDLKKGVDIKLVVKELDTRIKDDNSKVVMLENVKLEEIPGIVHEKIEINDFTNAPKIGYLAERERSKNQDKIIKFQFGKFTRALISQKFDLFDSVVADKVDVMGQFESKGDFISALSRASSKVDADELEYLSVDDYYDLKSLKISKSNDTAFAVNVNTKKNDVTKNFPFWKEHQTLIFTKEDDNNWFLSSIK

SEQ ID NO: 651 - protein, 442 aa, Borrelia garinii
MMRSLYSGVSGLQNHQTRMDVVGNNIANVNTIGFKKGRVNFQDMISQSISGASRPTDSRGGTNPKQVGLGMNVATIDTIHTQGAFQSTQKASDLGVSGNGFFILKEGKNLFYTRAGAFDVDSDRHLVNPANGMRIQGWMARDLEGEKVIHTASDIEDLIIPIGDKEGAKSTKNITFACNLDKRLPIIEEGASSADIARGTWVVNKSLYDSFGNVSVLELTVVKDLNTPNLWNAPVLINGEQNSNFTIGFDNEGALASLNGQPGQKEDILQIPITFNVVGANVGEVGEQQTVNLKLGTVGSYTDSITQFADSSSTKAIIQDGYGMGYMENYEIDQNGVIVGIYSNGIRRDLGKIALASFMNPGGLAKSGDTNFVETSNSGQVRIGETGLAGLGDIRSGVLEMANVDLAEQFTDMIVTQRGFQANAKTITTSDQLLQELVRLKN

SEQ ID NO: 652 - protein, 448 aa, Borrelia garinii
MNKLEEHYIVPKDVVLELDKYIIGQDEAKKLVSIALVNRYIRSRLPKEIKDEVMPKNIIMIGSTGIGKTEIARRLSKLIKAPFIKVEATKYTEVGYVGRDVESMVRDLMSIAVNMVKEEMYNTVRDDALVKTEERIVESLFKGSGNSENVDPNEIKAEEKVKEKLRKKLRAGELDNTTIEIQISSKMPFSTIEIFTGGNFEEIDMGIGGLLGNIFDRKKKRELKIKKAKEIILAEELEKLVDHENISDIAKSKVENMGIIFIDEIDKIAAKNRSGNDVSREGVQRDILPIMKGSKVNTKYGIVDTSHILFIAAGAFNLAKPSDLIPELQGRFPIKVELKSLSIDDLKKILKQTKNSLIKQYVAMFKVYNLDLKFSEEAIDRIAELTFNMNLENENLGARRLHGVMERVLADLFFEVPGSKLKKFEINLDYVNKKIQINEQKDLNYYII

SEQ ID NO: 653 - protein, 227 aa, Borrelia garinii
MRKTIIIALFYGLITNIYPEIKSTSKLNEQANKYKIEKLYQKSMLLKNSKKYNKAIANLKKIVNMDQNQVDAHLLLSELEYLNKNWKKAIVKSQDYLKIIDFKDKKNFLDISWAYFLIGEVENSMDYIIKFFQSGKELFKENIFIAIDALFKKSIYHFINNENEAFNTILTSTFQLALNDDTLFIIFLNNLEIIKQIPFYYFNRKKLKELYLQISALKTIQNTMCKT

SEQ ID NO: 654 - protein, 376 aa, Borrelia garinii
MNIKNKLILMLCIVVAVSFIACKTPPEARESKNAKIAKPDTKSFELRDIKDIKNEVIKERGHLFYSKEFNEAEKLEEVMKQNFSKKKAKEVNEIALKVLERYKPIIKEPREKKEKVNYLKENIEKYLNDAEANEAYIWIPLEIDEVNNLYFEATRKYKNYDLDDALDMYSKAFNRAQQAAKNAKEAKALKETDERMYKQLKALEAASNLPIYSNNKLIKPSPWNGRAFIKERNSHLNLLNINEDTYLLGETETPIVLAYAEKLEIAKNSKPQEQFKTLELIERSRKLWEKGVEAKNVKNFRLANELFLESARYLEAYQSNASSELYVIKIGNTLWGISKKLYNDPYLWPKNWFGYRQKIQNPDLIHSNWKIIIPAK

SEQ ID NO: 655 - protein, 527 aa, Borrelia garinii
MKLQKLLFSVIFFLTFLCCNKEEKKEGISFKISLGSEPSSLDPQLADDNVGSKMIDTMFRGLITGDPNTGGNKPGLAKSWDISPDGTVYTFTLREKIIWSDGVAITAEGIRKSYLRILNKETGSNYAEMVKSTIKNGQKYFDGQVSDSELGIRAIDEKTLEITLESPKPYFIDMLVHQSFIPIPIHIAEKYGQSWTSPENIVTSGPFKLKERIPNEKYVVEKNDKYYNSNQVEVQEITFYTTNDSSTAYKMYENKELDAIFGSIPPDLIKDLKLRSDYYSSAVNAIYFYAFNTHIKPLDNVKVRKALTLAIDRETLTYKVLDNGTTPTRRIAPNFSSYSYAKNLELFNPEIAKTLLAEAGYPNGNGFPILKLKYNTSEAHKKICEFIQNQWKKILNIDVELENEEWTTYLNTRSNGNYEIARAGWIGDYADPLTFLSIFTQGYTQFSSHNYSSPEYNELIKKSDLELDPIKRQDILRKAEEIIIEKDFPIAPIYIYGNSYLFRNDKWTGRNTNITERFDLSQLKLKK

SEQ ID NO: 656 - protein, 541 aa, Borrelia garinii
MNFNKAKKIGRKIKIAALIMLAISLITCNNNSEKEKLTFKVYIGGAPSSLDPHLVDETIGARILEQVFSGLLALNTKTGKLMPGLAKNWEASKDKKTYQFYLRDNLFWSDGVSITAEGIKKSFLRILNKETESTHVDMLKSIIKNGQEYFDGKVSDSELGFKAIDSKTLEITLTSPKTYFLELLLHHTFMPVPIHVIEKYKENWTNPENMVTSGPFKLKKRLPNEKIIFEKNEHYYNAKEVELEELVYITSDNDMTVYNMYKNNEIDAIFNSIPPDIVNEIKLQNDYYQHKSNAIYLYSFNTKIKPLDDAKVREALTLAIDRETLTYKVLNDGTVPTREITPDLENYNYGKKLALFDPEKSKKLLTEAGYPNGKGFPTLTLKYNTNETHKKVATFIQNQWKKILNINIMLTNENWPVLTNSRNTGNFEIIRIGRIGEYLDPHTYFTIFTSKNSQLASYKYANLEFDKLIKESDFEQDPIKRKNLLRKAESIIIEKDFPAAPIYIYSGHYLFRNDKWTGWSPNVSEIYYFFELKSIKNAKRN

SEQ ID NO: 657 - protein, 399 aa, Borrelia garinii
MEENDFIKFGSYLRKVRNGKNLTLEMVAEDIKISIKYLKALEDSNIEIFPNEVLAVGFLRTYSEYLDIDSRLISTLFKDYKSKLNNSYIGIRSEDKISNLGFLSDNKVLDKKLFFLNLESLSILKILLGIVGVILLLFVFFAFREVEVYFKKFFKLSQNEKIISNLHEVSFDKKNFWNISLKEGDSLFLTYGDNIAKYRASFISDDLVIVDESKKSKNIFNLGEFKEINLDDNIRVKIIYENYYYDKSKIANVSLESFALNVKYVSETNIDNRFNILNWQFDVKGTEKLPSGDYLTLYSSQKLSNVDLKIDFLNDTFFRYADENNLHGKSFFASKGIPINLAFEKSLILFFSRLSDVNIILNERDITPFLKEQGKEIFAVQFFWVKTPSGFDLKVSEVY

SEQ ID NO: 658 - protein, 472 aa, Borrelia garinii
MSLNYVEINTLIKEIPFANSLIKEIIQPDYKSLILEIYNKIDNKKFKILISLNPSTTRFHITRKNFKKNALKLRFSDFLKSKIQNGKILKASQMKNERIIYLEIFKKDIIILFIKLWPSSPNIIATNQNFKILDAYYRRPKAKETTGETFLKAKEIHESNKMPDKKIMGLKEEYDNTSHKSYSEFLENYYESLSNQIKKNNIKELLIEKYKKELIALEKRIGSLKQQIKLIKNIENEKEKGELILLNINKIQKGIKEIALLNYKEEKIKISLNQSLSPKENALQYFKAYKKGKNSFETIQNQLKDNLDKFNLIKSKINMLKIKNFIPKEEYNQEETAIKKKEKTPKIGLHFTSCGFEILIGRNAKENDELLRRCVKGNDYWLHTRDYPGAYVFIRNQKNKTPCLDVLLAAGNLCVFYTKLAKKSGKADLYYTQVKNLRRVKNGKLGLVIPKAEKNLHIKLDEDLIKKIKNKT

SEQ ID NO: 659 - protein, 599 aa, Borrelia garinii
MKREIYAFLSNFIIFLCFFLGLIFSYSYFFGENFLEKHRLIAAFFDSILLFYKYFYGFFIFIVCIYFAFFVQQEIKIYLKSYNGYLFSRLYAFLLLFFIIGLFFTFIFNLILPYIIAQRNEYKFSYDRYNLLESEANEISLKIKNIDISLSSNRLFLSTDLSDSMKQKRKHLENLIRIYDKMRIIYVNNEELLTNYYLVKSEYNKIPSYDVDLEKVKKTFSRYPLRSLKKQDFFNIVNEFISQNDYHTANYFAYIAYVATKDDNFVALLNLTLKFINENRNFEKEKMQLISEEKQKNFLYLNTEKFKLAYYGFSNLHKLLPSDNEILNYKNKSLEKLRKKYLFFDEIEKYFEYYGINDVFLLQPDSNKRFYDYIYMQKVVTLNNYSKIIKNFELIRFNKAGNVILHIKIPFATLRGNFVYQNVLNKDDEQSEITLTKVFVSVDSFDTNVLEVVKINENVENLALFSNFSEVGFFLKIQSLSSAFNKVAILNLKLINIFSLSLILLISPILLVLMGAFFISLFSKIEFNFNSKAMIFLVSLMIAIFSGIICLFVNYFLIVFTSLLIYTFNSVHISLAILSSLLFFLIFKVIVGNYKEKHI

SEQ ID NO: 660 - protein, 476 aa, Borrelia garinii
MKNKFLICAYFLLTLSISSLVIVESIFAVDESNNNKLSRSSYEQMMIQAFEFVKENYVEPVNDEVIFEGALKGIFQALGDPYSQYLTKKDLEEISKTTVGDYVGIGISIIKKMHSQDKQDKAKNLDSNSFCVSIVTPFEGGPAYKAGIKSGDCIIAVDGKSVSSMEVDQVVDRLKGKEGTKVKVSILRGKDLTLDFELTREKIEIQTIKYDVINPDIGYIRIVSFNPYTSVDFSKALDNLKNRNIKSLILDLRLNTGGYFQAAIKMADDILSKGTIVSTKSRNSSKPIDYKASSKQVLPSDIKIVALIDRSSASASEVFVGALKDNKRAYIIGEKSYGKGVIQHVVPFYTGGFKITSSKYYTPSGKSIHKVGIEPDLEIKSPDFSEEEAVIYKEIFDKKLIEGFLKGKKSITEQEIDFFVENLVKENPKYKIDKEFLGKYVFFNYYQDNNKELPIYNLHYDKVLKAACEYLSKLGN

SEQ ID NO: 661 - protein, 458 aa, Borrelia garinii
MKKQNPWISLSEEEKNQIFNFSESYKKFISKFKTEREVTSYALDKAKKRGFIDAEEKKNLIPGDKIFYTCREKSVAFAIIGKNPIENGMNLIVSHTDSPRLDAKPSPISEENELAFLKTNYYGGIKKYQWLSTPLSIRGVVFLKNGEKVEINIGDNENDPVFVIPDILPHLDKKIQRNKKSDEIIEGENLKILIGSLPIESKEQDKVKLGTLQLIKEKYKIEEEDFVSSEIEIVPAGTAKDVGFDKALIGAYGQDDKICAYASLEAIFDLEEIPSKTAICFLVDKEEIGSTGSTGLDSRYLEYFVSDMIFKIKKSEYNNLQVQKALWNSKSISADVCAAINPIFNSVHDAQNAPKLGYGIPIMKYTGHGGKVMASDADAELVSYIRQLLNKNNIAWQVATLGKVEEGGGGTVAKFLASYGIRTIDMGPAVISMHSPMEITSKFDLYNAYLAYKAFYKE

SEQ ID NO: 662 - protein, 341 aa, Borrelia garinii
MRIVIFILGILLTSCFAGNEIESGSSKIKISMLVDGVLDDKSFNSSANRALLRLEEDFPENIEKVFSSAASGVYSSYVSDLDNLKMNGSDLIWLVGYMLTDASLSVSLENPKISYGIIDPVYSDDVQIPKNLIGVVFRIEQGAFLAGYIAAKKSVSGKIGFIGGVKGDIVDAFRYGYEAGAKYADKGIEIVSEYSNSFSDVNIGRAIANKMYAKGIDIIHFAAGLAGIGVIEAAKELGDGYYVIGADQDQSHLAPRNFITSVIKNVGDALYLVTSEYLKNNNTWEGGKIIQMGLRDGVVGLSNANKFEYIKVIERKIVNEEIIVPYNHEGYEIFIKQILKL

SEQ ID NO: 663 - protein, 1377 aa, Borrelia garinii
MKEIKDFEKIKIKIASPDQIRNWSYGEVKKSETINYRTLRPEKDGLFCERIFGTTKEWECYCGKFKSIRYKGIICDRCNVEVTHFKVRRERMGHIELAAPVAHIWYYKYIPSRIGLLLDITASSLNSILYYEKYVVIEPGDTDLKKMQLLNEDEYIEARERYGMSFNASMGAEAIKTLLENLDLDELSSKLRIQMIDKDDKTDKKLLRRLEIIENFKVSGNKPEWMIMEVLPVIPPEIRPMVQLDGGRFATSDLNDLYRRVINRNNRLRKLLLLNAPEIIVRNEKRMLQESVDSLFDNSHKRKVVKGSSSRPLKSLSDALKGKQGRFRQNLLGKRVDYSGRSVIVVGPELKLHQCGLPAKMALELFKPFVIRRLIESEAVFNIKRAKNLIEQEVDEVWQILDFVIKEHPILLNRAPTLHRLGIQAFEPVLVEGKAIKLHPLVCHAYNADFDGDQMAVHVPLTPSAQAESWALMLSTNNLLNPANGHPIVFPSQDIVLGLYYLTMEKKNIVGEGKKFLNFSNVILAINNRSLDYNASIYVKIDGEYKKTTAGRVIFNEALPKGIEFVNKTLSDLELQILISKVYVVHGSSTVIEMLDIIKELGFKYATKFGCTISMSDIIVPDEKKTYIDRANKEIAKIQNDYAKGVITGEERYNNVVSVWLKTNEELTNKMMEILKKDRDGFNVIYMMADSGARGSRNQIRQLAGMRGLMAKTSGDIIELPIISNFKEGLSVIEFFISTNGARKGLADTALKTADAGYLTRRLVDIAQDVVVRIEDCGTINGIKVETVKNGEEILESLKEKAVGSYSIERIKNPITGEIVLDANEEISEAKIELLEKIGIEKLVIRSVLTCEAEHGVCQKCYGRDFSKNKPVNIGEAVGIIAAQSIGQPGTQLTMRTFHIGGVAQAGSEDDKISLKNAFILNSIEGFNVNVDNGILFTRKGTLKIINVFYEEKIKNIKEIKVLDSQRVIKGIPLFVNKKGVEILSSYIGYAKLRDDKFLIVSEEQEVALKAGTKLEIGVGDYVESGKVIGTFDPFAEPIIAEVKGKIKFKDIILGTTLKEEINTETGNVEKRITDNVFESLDPRIFIIDSSGMEVASYVLPGDAYLQVEDGQNINIGDVIAKLSKGSEKTQDITGGLPRVNDLFETRIPKNLTEMAKVSGIVQFKSIQKGKRLINILDEYGVEHKHYIPAGKHLLVRDGDVVKAGDMLCDGRINPHDVLEILGGISLQEFLLAEIQDVYRKQGVSINDKHIGVIIKQMMKKVKIVAVGDTNFVYGQKVDKHTFYEQNRKVIEQGGEPAIASPILIGVTKTSLNIDSFISAASFQETTKVLTDASIAGKIDDLRGLKENVVIGHLIPTGTGMGLYKKIKVSENIDAKV

SEQ ID NO: 664 - protein, 1155 aa, Borrelia garinii
MIKRVHLGQGRADEILDLPNLIEIQLNSYEKFLQLDKLKNKKPLLNEGLESVFRNIFPIKSGNGDVALEYERYYIENDALNFTEKECKRKGQSYEAVLKVRLNLQFLTTGEIRQKDVYMGTIPLMTERGTFIINGAERVVVSQIHRSPGVVFYKEKDLYSARIIPYRGSWLEFEIDSKKDYLYVKIDRKKRILITLFLRALGFDTREKIIETFYNIKKIKVEDSTKRDLPGQYLAKSINIRENMYYRAGDKITLQDVEDFLQNGVNEIELVDFDGYDAISGKCFVSSNVILNCLEKEDAFFALKDGSKELPKESVMLAVYGALFPGEPISIDNAENDLKTIFFSERRYDLGRVGRYKLSKKFGFDDLSTSVLTMYDIVNTISHLLRIYEGHDILDDIDHLGNRRVRSVGELLTNIYKGAMSRVEKIAKDRMSNKEVFNLKPQELISVKPIVSAVKEFFATSQLSQFMDQVNPLAELTHKRRLNALGPGGLSRDRAGFEVRDVHYTHYGRMCPIETPEGPNIGLIVSLATYSRVNDYGFLETPYRKVVNGEVTDELEYLSAIDEEKKCIAQANAAFNSNGKYLEDLVSVRISGDYTTTNPKNIDYMDVSPRQLISVSSALIPFLEHNDANRALMGSNMQRQAVPLLFPKPPIVGTGMESVVAKDSGVVVKAKRSGEVILATSSKIVVKPFESENAKDLDEYHIVKYERTNQDTCFNQSVLVKEGQKVESGEIIADGPATRYGELALGNNLLLGVIPWNGFNYEDAILISDRIVKEDLYTSIHIKEFSIEVRETKLGPEKVTGDIPNVSEKILNKLDENGIIRIGTYVKPGDILVGKVTPKSEGDITPEFRLLTSIFGEKAKDVKNNSLKVPHGTEGTVIDVQRITKEDVGNLSPGVEEILKVYVAKKRKLKEGDKMAGRHGNKGVVAKILPVEDMPYLADGTPLDICLNPLGVPSRMNIGQLMESQLGLAGKYLGESYNVPVFESATNEQIQEKLKKAGFNPTSKEILYDGYTGEPFENEVMVGVIYMLKLHHLVDDKMHARSTGPYSLVSQQPLGGKAQFGGQRLGEMEVWALEAYGAAHTLQELLTVKSDDMSGRVKIYENIVKGVPTNVSGIPESFNVLMQELRGLGLDLSIYDDNGNQVPLTEKEEELINKG

SEQ ID NO: 665 - protein, 347 aa, Borrelia garinii
MEKVFKIKKICFCLLLLLQAKIVLAQNQHDLKFNNEYFYFNFQSAYYPPHELGTSGSNFSQSFKHPNFQNIEPSLKIPANYWGGIKLISYLGYYKNFKALHNPNSIFFKNNGIEVDLNIGLSPVSISLKSMLSFTPIAFLNLYVSNEIGMGWKAFGFKGIGVHIENGKYSNDIEFYSEITIGGRFQFDLNAIFKGEWTHIITVIGNDFTYLINPHANKDQLWKYKADDGKNINGMLIKPYALLAYKMPIPLNTIGLLYEGKTQIGKERNISSWKNKGWGSDIFYHNISLIANFEVVKPLTIGLQLKLSTNPTYTSNTAGLADVSKRIATGNSYFYYDSIGISVTYKY

SEQ ID NO: 666 - protein, 1496 aa, Borrelia garinii
MKKANFLSINFLILLLVCFFNVNLFSKDIFKFKLVGQYFPFYYKNGKGKYEGLIFPILDKWAKDNNFDIRVETIDNLNESKIEDDSIYLGLTYRSKLNDLFYFKSEFSRSIAILFSKSSNKKYKNAHSPWLSNFNIGVVKNPIYEEFLKLRRANTIFLVDNAEELLLALKNDKVDYIYGDCKTLAYIAKRFLGEDLAIFNGDIFYSIKNRVAISRNAPEIIKNLNLDLFSYLMEIPDEHVFSFLDSTSKGNFIDIGLYNDYPPLSFINSKGKLSGILVDLWNLLSRQHIFKPIFKGFPKEDIKKSLDGKSVGIFGGIISNDSVFKNVNYVVSKPIYPLNFKFYSKGLSNNVGPINSQFIDFDFNNIQLNKNQDIVNNFIDIVNNSYGFIENSITTKYLLKLNGYNGRLKSYDSIFNKNRFLVLAIDNRIYKVIKYILNSIFDDISFESLLQIDKNWLDKEEINSSRINSYKIMNKLKFNIEEKIWLLKNNKLNLAVKNWYPIDYVEANNYKGINQFLLDKIRMFSGLEFNIIETHSILDLKKLIKSGKIDMLNTNAIDSNLDNVFNIKLNSRIPLYIFSNKKRVLPSRSLERFAVLDFLYNKNLTSNIKSKLILVSSFKEALLLLYKGKIDGIISDEYTAAAVFEELNVADVEKLPTFRDLAFDLSLAIYNQDYILKEIIQKVVIRSNVDSQKYLNDWKFDIYYKSKGIRFKNFKFLVLTVIIFYFTFLGFVIILMFKLSFEQKRKYFSVMNEKKIAESANTAKTIFIANISHDIRTPINGIMAATELLDTTILTDVQKDYVRMINYSSDSLLSLIDDILYLSQIDVNELYVDSQEIDLESEMEMVLKIFQSQCAKKNIDLFSYSKSIFKNYIKGDIVKIKQVLINLIGNAFKFTDDGVIVLNYEEVCRTRVDDNRVLVTVEFKVIDTGKGIKRENLSKIFEIFKQEDDSSSRVHEGAGLGLSISRELIRLMGGLGIAVDSKVGEGATFSFMLPFYLGDELKSESLSINTFQLINSNNKVKVLNVLLSQKSIKIFEHCSTLLGESSNVDYVASFEDAYKSFKEAPFYNFVFVNVNNDNIKESIRFANNIERLSPDVQIIFLFYYLDNKALKNLKYMYVKKPLMGLGISSILSKKEFKIETDFEDLVPIDSAFKIKGPINVLIAEDNQVNQKVLKDILVVIGINENLIDVVDDGLKALKSLKEKQYNISFIDIRMPRYDGFSVAREIRKFEKAKNLKPCVLVAVTAHALQEYKDQCFESGMNDYISKPIHISSIKIILKKYLQFEVDDTWENKDLNQPVNFPHLDINRALKELNLSYALYSELCRGLVDFISINIIDLEKAFDEENLPLIRDISHSISGALSNMRSELYKDFKKIETSKDSIYELKKMYSFVKDDLLRLINNIKENVLLESEVISENKLYFKNNDQFLTLLNKLLIGIKTRKPKEYKEILESIEKYVLDDNIQILFSDLRRNLRLYRFAESSKILKEIIEMFSNKRY

SEQ ID NO: 667 - protein, 260 aa, Borrelia garinii; identical to SEQ ID NO: 426

SEQ ID NO: 668 - protein, 634 aa, Borrelia garinii
MNYVASNIQVLKGLEAVRKRPGMYIGSVSVNGLHHLVYEVVDNSIDEALAGFCDRIDVVINLDNTITVIDNGRGIPTDIHEEEGISALELVLTKLHSGGKFNKGTYKVSGGLHGVGISVVNALSSFLEVYVNRDGKIFRQTFSKGIPTSKVEVVGESSVTGTKVTFLADSEIFETLDYNFDVLEKRLKELAFLNDKIYITIEDKRAGKEKSSKFYFEGGIKSFVDYLTNDSKAFQSESYYIDGFINDVIVNVGLKWTESYSDNILSFVNNINTREGGTHVMGFRSGLTKAMNEAFKNSKISKKDIPNLTGDDFKEGLTAVISVKVPEPQFEGQTKSKLGNSEIKKIVEIIVYEHLLEIISSNPLEIDIILEKAIRAARAREAARKARESERKKNAFESLALPGKLADCASKNPSEREIYIVEGDSAGGSAKMGRNRFFQAILPLWGKMLNVEKTREDKVITNDKLIPIIASLGAGVGKTFDITKLRYHKVIIMADADVDGSHIRTLLLAFFFRYMRDLIENGYIYIAMPPLYKIKYDNRIYYFYDEKEKEKFLDSIETKNRNNIFLQRYKGLGEMNPTQLWETTMDPARRKMRLINIDDAIEAEKIFVTLMGDLVEPRKEFIEQNALNVINLDV

SEQ ID NO: 669 - protein, 586 aa, Borrelia garinii
MFKVIKCNELNEKLINKKVEINAWVKKIRHHGKFIFLNIRDRYEKAQVLITEEHLLKIAEKIKLEYCIKIQGLLSKRPPNMINENMKTGSFEILAKNIEIISKCNELPFMIEDDNNASENSKLKYRYLDLRRDSLKNKIILRCQATHLIRNFLVKKKFLELETPTFVKSTPEGARDFVIPSRIHKGSFYALPQSPQLYKQLIMIAGFDKYFQIARCYRDEDSRGDRQPEFTQLDLEMSFVKKENIFKLIENMLFLIFKNCLNIKLPKKFKKITYKTAMNKYGSDKPDTRFELTLQDISRNLKNSEFNVFKETLKNKGSIKILIVKDEADKFSRAKINNLEEIAKLYKTQGLYFAKIENNKFSGGIAKFLKTEEQQLIKTYSLENNDIIFFTANKKWETACKAMGQIRIKIANDLGLIDENKFEFLWVYDFPLFEYDENTKTYTPAHHMFSLPKKRYIASLEKIPNKTIGEIYDLVLNGVELGSGSIRIHNKELQQRIFNIIGFQKEKSEDRFGFFLKALEYGAPNHGGIAIGIDRLIMLMTKSTSIKDVILFPKNSFATSPLDDSPSKISNEQLKELGINIVTDDA

SEQ ID NO: 670 - protein, 229 aa, Borrelia garinii
MKTIDHEFYYEFRVADDVRMIYTKKPFHLNLRELNNDNLNFVPKSKKIKYLKQLHTDIIYRAEDDFINFQEGDGLISSSLDVALVAYFADCLPIYFYDSAKKIVGLIHSGYKGSFSLIILKMLFMFEKMGSTFKDLKIVFGPYNRSCCYEVSEIFLKEVGNKFSKGLLNTVFDIRDGKIYFDNASFNLNLLSSFNLNIYNSKLCTHCLKNLYSYRRLREGQSYALIWRI

SEQ ID NO: 671 - protein, 427 aa, Borrelia garinii
MYSYIVEGGFKIGGQITASGNKNSALPCILAALLTNEDVILENIPNINDVKVVLDILSDIGADIVREGNALKIKVSNIVKTEIDSSFTDLIRASILLLGPFVSRFGEIDMALPGGDVIGKRRLDTHFYGLSKLGAKLINKDGRIVLKAKKLVGAEMFLDEASVTATENIIMASVLAEGNTVIMNAACEPHVQDLCNMLNSMGANILGIGSNVLEIKGVKKLRGTTFRIGADFMQVGSLISLAALTGGELEIKKADPQHFRLIRHIYSRLGINFEYDKENVYVRDKQELKVKLDFGGHIPKIDDGPWPAFPTDLMSIIIVTATQVEGTVLVFEKMFESRMFFVDKLIKMGAQIVLCDPHRVVVTGKSPLKGNVLSSPDVRAGMSLLIAAFVAEGRSEIQNVYQIERGYEDVANKLINLGAKIKKVKSQ

SEQ ID NO: 672 - protein, 209 aa, Borrelia garinii
MERKVFSKDGKEIGTINLDDRVFNIEISHGSIYNAIKNELSNLRVGTSSTKTRSEVRGSSKKPWKQKGTGRARVGTKRNPIWIGGGIALGPKPRDYSYRLPKKVKRLAFKSVLSLRAADENNFKVVENFNIESGKTKDLALIIKNFASFNGKVVILLGNDDQMIKRAGKNIRDLKILSFNKLRVVDLFYAKNLIALESAVNKLNEFYVK

SEQ ID NO: 673 - protein, 2162 aa, Borrelia garinii
MIDFATILVNLFLVSIVLFIYRQYDKRSRALDKIKKFIDLVKVNLEDFIEDKTKEINDLAVDMEAYQRSSIEIIKKIDEVQPKIKNKSNDFAEVEKKIAYHDSMLKDLDEMTLKVQENIQRLQVDGKIVDKLSKTLKGFNTQIDSVESNLNSVLEKFEKSNKENLESIKIASWEKFDINIKDLVFKMDNLNREIDLYEKDLANIEERKKDILDKGNEKLDLEFNDFLEKVEFNIGKYNKEIESSFIFYENKYKLIEDSIELIMESVKNKINEKEDFILNRLNEELENKFKDIFTYVDDRSREIQDKLEDKLILVDNEISSMSSSFKDNVYSRINSLEESIRIEMGKYEEQVDDVFDKFRSQVELNLKNIYEDYEDKISQVDKNIRERVELSLLDLNSKMESVQTGAISLIKRLEDDSNRIYLEFKNKFESDIEIFSESFKDDINQLKRQLESQLLDVDSNMQEKLIKLNDNLISNFQEIDGRFNNNYSNLTDNINSKYITLFESLDSSSSKFEDQMESKYKGFKDKLTAEMDEFSLVYSEKFDTLSQEAINNYQEFQDLNKKLENEIESLCNMFEENQEILKRDFNTNLINIKDEIDKNIVEFKDRYSDEVNNFVSKLEESKLQYSKWQGDMDSNLKNIESQINKTNEEFLSLIQIQKDKGIELSENVFNDLSDHIQKKAIDIHGSWKDELIALNKSLLDIKISSEELLSSATLKIENLERDVNDRIEYVLLKTGDIESLVIEKYKELKDMSYSQSDEAILGIKEFINRQTEIIKDKSVFMLEDLNKKFDDKNNFVISKIEECDYKLKDFKSESEDILNNFKSDLNEFIESKLQIVSNIKSDNQKQIDDFLDRISKDILNRKDSINNEVDSKLNDWQSKLNEITVKIENLLSSGKVDLDLIDSEVTTKIKELKFSIESLESYYLEKIDEFRNQGAIYSDELLQDIMNHFNKETRELEENLSKKFAVVLNNSEEFVKEVDSLLQDKRTDIASFQANIDITLDSLSVKFNDINKEINGKYNEVISNYRGYSENISSKLENEIMHEIENINRRLTDRIDNLSKGMDENLQKLKESFDVSKYQVEKFELKVKDLTDSGEAKISEFIKEIEQYYKSRLEEAIDYRRTIDSDIMQAKERFGEITNDLKNNIESKSEFLNDLYKERFKLIESNFEERYSTFLIESEGAISKIRDEIYKTLTINDENLQIKISEMDHNFEIIEQRSKDILEFEKELRDKIQDCYGIINSQFGEIKGSVEENIKNHFEVCIKKVNTLIDDDIVKYENEIHKRIDSLKSIENTFDSIEKNLNDKVNGCIDKISNDFNLKYIELEERCNEGQLNLESKIDNKIKAIDNLALSQYDGLEKKYADMYDEFLERLNSHIATLSEEFKHSNKEMIFELESQLKNLKNLESDLNNVEKDVIRLKEESYHNVSSHLKLLEEDFFKDLKIRGEELKYSLENFIASHNDKIQNLEYDLSKNLENKTELIQSFRLDIEQKMKNDKETFYLDFTKEFSSKKKDMESEIALMETNITERIDEFIDFVNNRQNIIDSWFLNIKDDVKNWQEKSYSAIEKKISLAELEIKSFENDILNVKIGLESFKDSFEIKAEEIFGNLQSEAKKFEQSVNLDFKNIGESLNLKVLDLEKFVDFKVEKIDERVNKKTEDILIQAEVKFLTQQKSLEDRIFELNQKLENEFTTLSSNLDKVRREMIDVISSDKKSFEGQIELMHKNISEFSEKIGLYRNNIETSIENEYNAFSKSIKSEFGLLEDELKKNLKHSTLEIETVKNDLQEQIDKFEVEFKKNHKKLLKEVDTNILELESKILNCDTEFNKFISESKDNLVEYKSDLRKEFEDSYDKINFQIENFKKLDAELEKNNSIFLEAYSLKEKLEKLWETLKNEINLAQEYKNNFENVNKEFYNIQKETLGIIETFNELKLEQESIKAIKNDFNRFFEFYSSFDSRYKSLIESYDEMQIYKAKIKEIADEQRNILDNYERISNKEGILKSTIESVDKNFDLINEMEKRFNNLSKESANFQNNLKDMENVVSNLLLNKGLSEEVLINAQNLKEMLLDIENRLKNTLTMREKVVKSETRLENLNIAAEERIKTLGILVKTDSKYQDNVGLNNETVRNSVIKLMRQGWSAEEISRATKLSIGEVELILELGISNKGD

SEQ ID NO: 674 - protein, 635 aa, Borrelia garinii
MGKIIGIDLGTTNSCVAIMEHGKPVVIQNSEGGRTTPSIVAYTNKGERLVGQVAKNQMVTNPENTIYSIKRFMGRRFEEVASEIKMVPYKIEKGLNGDARVNISNIKKQMSPPEISAATLTKMKETAEAYLGEKVTEAVITVPAYFNDAQRQATKDAGKIAGLEVKRIVNEPTAAALAYGIEKKHEEIVAVYDLGGGTFDISILELGDGVFEVKSTNGDTHLGGDNFDDEIIKHLISEFKKESAIDLSNDKMALQRLKEAAEKAKIELSGAQEASINLPFITADANGPKHLQYTLTRAKFEQMVDHLVQKTKEPCLKAIKDAGLKASDINEVILVGGSTRIPAIQKIVKDIFGQDPNKGVNPDEAVAIGAAIQGGILTGETKDMVLLDVTPLSLGIETLGGVMTKLIERNTTIPTKKSQVFSTAADNQTSVDIKVLQGEREMAAQNRILGNFILDGIPAAPRGVPQIEVSFDIDANGIVHVSAKDMGTGKEQKIRIESSSGLSESEIDRMVKDAEAHAEEDKKLKENIEAKNTANSLIYQTEKSLKEYSEKISSEDKEAIENKIKELKESLDKEDISLIKSRTEELQKASYKIAEMMYKDSSQQNASNQQENGTQSNTSEEGKEADYEVVDEDKK

SEQ ID NO: 675 - protein, 187 aa, Borrelia garinii
MEKKETKNDAEKNNKQDNKSTKSQKKENLNLVNSDKKITELENEISNLKDLYLRKQAEFENFRKRLEKEKDNFVKFANETIMKDVVNFLDNLERAINSSRKSKDFDNLLTGISMIENEILSIFDKKYNLKKFGENGENFDPSRHEAISIEEKEDLKNPEIVEVYQKGYCYNDRILRTAKVKVAQSKN

SEQ ID NO: 676 - protein, 227 aa, Borrelia garinii
MKDLNENNDNNKGFFVALTSIATVCIIIFLGTIIFFPNKNLASDIAEKNIVLEEAKDQNILENIDENEKSLKVSETPNEIIIDLTQDLNKEKKLTSKTPNTSQKSKPIEKSQPVAKKIPNTSQKSKPIEKSQPIAKKALDIDSVYDPNTEYYIQFVSLSDPINADNYIQKLLKYNIVAKIYSATVDNKDIYRVRSGPYKTKSEAKADFKKITGISEFKETYILPVNK

SEQ ID NO: 677 - protein, 495 aa, Borrelia garinii
MNKTKNQSFKYFIMLLCISLFGANNTINYSSIEIPLEDLSEEFKDTGNKNDQINTSKHLNKKIVSYKDPKKGKELKLPENIRDEKLLKKRMDENDLKSIIENYENKIKNIEKLLKAKNQKASSNENKKIESIEKKAKKYEILTNKLKNEITEIKKLLNKRSKPKEDENYEKINIENIDDDDDDFEENYEYNDEIEEINEDKYPSNEGIINSLKENLHANEKYYAINEKKIDELEDRINDNENTILDLQRELRNFKKKDNSDKNLEEIEENLSSIGRIINDLKEKISANEAINKENQKKIRTDKHKLKELEDKIKENEETILKLQKELNNFKKKEISQKSSNEETFIPSITNKNDELEESNKLEKKYFKPIEKNESEDLEEKAKNTKKTTMIKTANFQVYPDIYINNYKFKEKGDQFAFKKENTYYIEIDPTNNLNEALKNHEIISKYKFEKYFINPTLKNKEEFFRNLIEVKNIHELGIMYKSLKPKFKQIKIIK

SEQ ID NO: 678 - protein, 616 aa, Borrelia garinii
MKKQFDTEVNDLLYLIIHSLYSHKEIFLRELISNASDAIDKLKFLSLTNEKFKNIALEPKIEITFDDKSILIKDNGIGMNEQDLTNHLGVIAKSGTKEFINNLKQDEKKSASLIGQFGVGFYSAFIVSEKVEVTSKKALESDAYIWFSDGKTGYEIEKAKKEESGTEIKLYLNKEGLEYANKWKIQEIIKKYSNHINYPIYIKYSEPIMKDGKQEGIEEKEEKLNETTALWTKNKSEIKAEEYNEFYKNTTFDYENPLMHVHTKAEGNLEYTNLFYIPSKAPYDLYYPNTKPGVKLFINRIFITDSEGSLLPNYLRFIKGIIDCQDLPLNVSREILQQNKILSKIKSSSVKKILSELEKLSKKNPEKFSKFSKEFGRCIKEGVYSDFENREKLISLIRFKSSSVDGFVSFKEYKERMKESQKSIYYITGGKENILKENPIVSAYKEKGFEILIMDDELDEAILNLIPEYEGLKLKAINKNETSNELKDENFKKIEEEFKDILTKVKEILKDHIKEVNLSATLIKEPSAIIVDSNDPTYQMQKIMLSMGQEVKEIKPILELNPNNKIVQNLKNLESEKLEKISILLFEEALLTSGMPSKNPGKFINIINEFLEKELL

SEQ ID NO: 679 - protein, 229 aa, Borrelia garinii
MLEIISLGGGVINSNQINIEFIKNFKNFVFKWLLENEKRKIILIVGGGKVAREYQDAYKKINPDFKVRELDEIGIMSTRLNAEFLCKVMNPLCKDKIVTNPLKNFSFKGKILIASGWKSGFSTDYIAVKFAEKFNKKDVINITNVNQVYDKDPKKFKNATAFKKLNWKQLQNIVGQKWNPGLNLPFDPIATKLSSKLGLTLYIVNGNNIENLEKVFNKNNDFLGTVIVK

SEQ ID NO: 680 - protein, 1147 aa, Borrelia garinii
MSFKAKFIHLHVHSDYSLLDGAAKISDIISKAKKCNMSHIALTDHGNLFGAIKFYKEAKKAGIKPIIGIEAYMAKTSKFFKKHDDLGKMSYHLILLAKNEIGYKNLLKLTSISYLEGFYYRPRIDKEDLEKYSEGLICTSACIGGLIPRLILGNRFEDAKNEILWFKKVFGNDFYLELQRHGIKDQDIVNERLVEYSRELGVPLTAANDSHYVNREDAIAQDIIVCIGTGAKKSDENRLKMETNEFYIKSQEEMCELFNDLPEALENTVRIAEKCDDFKITFPGPILPDYQIPIEFNTLGEYLEYLTLEGLKFRYKTLTSKIKDRAFYELSVIIRMGFEGYFLIVWDFIKFAHDNDIPVGAGRGSGAGSIVAYALRITDIDPLKYNLLFERFLNPERISMPDFDIDFCFEGRDEIIKYVTNKYGEDKVAQIITFGTLKPKAVVKDVARVLDIPFAESNELTKLIPDGPKVSLKEVLDDNSLKEYFTSKPVYKELMDAALVLEGMNRHASTHAAGIVISKTPLTDYVPLYKDYKQGSVSTQYTMDLLEECGLVKMDFLGLKTLTLIKNAENLIRSVNPDFKIKNIPDNDVKTFKMLGEGKSASVFQFESEGMQQILKDAKPDNIEDLIALNALYRPGPMQFIPQFIAAKKGVKSIKYPHPDLKEVLKPTYGVIVYQEQVMEVAKIIGGFSLGKADILRRAMGKKKEDEMDEMKVDFLRGAIEKGYDKEVASEIFELLKPFSGYGFNKSHAAAYSLIAYQTAYLKANYPQYFMAANLTNEINNNDKLSYYIEESKAIGINVLKPDINRSFKEFRVTDSGISYGLNAIKNLGEIVVDLIIDEREKNGKYSSFENFIRRVDDKVINKKFLESAIKSGLFDSLDQNRKTLFENLDRLIEVVSEDKNNKKLGQNSLFDVLKGQNPIHQNFNYQAFKEYSYSELLEFEKELLGFYVSGHPLDPYKKAINSFSSLNVLKDLATKKDSIVQFSGILNSVKVIQTKRNNAKMAFGVIEDFKGAIDIVVFTESYERYRDFLFESNVIGVIGRLTFNRDKFSIVVEKVVNIERLSEDKVKNIHIKFLNNKLNDLQLLNSLKESISNFEDNSGFSNVYFYLRENGKDLKLKMNSILNFVPDEDKLDKLRRCMIVEDVWVD

SEQ ID NO: 681 - protein, 264 aa, Borrelia garinii
MNNFLRKFFLFLLVFSNGYVAFSKNINVLIVTAMDSELEEINKLMSNKEEIVLKEYGLNKKIVKGKLSNRNVMAIVCGVGKVNAGVWTSYILSKYNISHVINYGVAGGVISDKYKDIKVGDIVVSSEIAYHDVDLTKFGYKMGQLMGLPQKFIANKNLVNKAKEAVKLKVRGSNAYSGLILTGDQFIDPIYIKKIIRDFKDVIAVEMEGAAIGHVAHMLNVPFVVIRSISDIVNKEENEVEYSKFLKLASFNSAKVVQEILRIL

SEQ ID NO: 682 - protein, 621 aa, Borrelia garinii
MKNHILYKLIIFLTTSVAIFAAADKLKEEDIFKINPWIPTFGIENTSEFRLDMDELVPGFENKSKITIKLKPFEVNPELGKDDPFSAYIKVEDLALKAEGKKGDPFQIDIGDITAQINIYDFFIKISTMTDFDFNKESLFSFAPMTGFKSTYYGFPSKDRIVRGTILARGTSKNIGTIQMGYKLPQIDLTFAIGGTGTGNRNQENDKDTPYNKTYKGILYGVQATWKPIKNLLDKNEDNRSVIAETPFELNFGLSGAYGNETFNNSSITYSLKDKSVVGNDLLSPTLSNSAILASFGAQYKLGLTKINNKDIYLILQMGTDFGIDPFASDFSVFGHISKAANFKKGISADPSKKTEDIFDPNGNALNFSKNTELGIAFSTGASIGLLWNKDDGEKESWKVKGADSYSTRLFGEQDKKSGVALGISYGQNLYRSKDTEKRLKTISENAFQSLNVEISSYEDNKKGLMNGIGWITSIGLYDILRQKSVENYPTATNSATDTNNQAGQSSESTQATIPNLTFEDAMKLGIALYLDYAIPIESISTEAYVVPYIGAYLLGPSNKISSDATKIYLKTGLSLEKLIRFTTISLGWDSNNIIELANKNTNNAAIGSAFLQFKIAYSGS

SEQ ID NO: 683 - protein, 476 aa, Borrelia garinii
MSIVIDSFKEISKIPRCSKNVKGIINFIKERSKKFGYSFKEDSVGNLVVQIKSNSNINMHPIILQSHVDMVCEKNESSLHNFETDPIEIVEEDGYLKGVGTTLGADNGIGVAMMLSIMSEANSFSHPDLELLFTVDEEIGLIGALSLDSKLCSGKSLINLDGEEEGYFLVGCAGSRLVEIVFSPQYSLATKKTKVEILLKGLKGGHSGADIHLDLANSLKLMFFALFEIKSNIDFEIESIFGGDSSNAIPNEAKALIFINDSDYDLLSKELKLFVFKVKSVYSLEDEFDIVVNKKEFSSVKVLDENSKSKLLNMGMGFLHGVQKVENYENKLIKTSLNFSSLFKIKDDYIFTFLIRSLFDSDKEYVFNHLQSIGGLSGANLRVIYDYPSWKSNKNSNLLKHLKEVYKEMYLEDANVSLIHAGLETGIISSRLGGIESVTLGPWIESPHTTRERVNISSTIRVYDFLKKSLERFQKF

SEQ ID NO: 684 - protein, 435 aa, Borrelia garinii
LVKIFMARLKGQKVKECSFCGLSVAELGGNVVISNGVAICPECSKICHNLFKEKLSNPLDSKSNGLPTPKQLKDHLDMHVVGQEDAKKVLSVAVYNHYKRILKNNKYDNGIEIEKSNILLVGPTGSGKTLLAKTLAAEMNVPFAIADATTLTEAGYVGEDVENILLKLIHAAHGDVSLAEKGIIYIDEIDKIAKKNENVSITRDVSGEGVQQALLKIIEGTIANVPPRGGRKHPYEDTIEINTQNILFICGGAFVGLENIVKNRINKSSIGFSAIEKKNIREDTSLKYLEMEDLIKFGLIPEFVGRLPVHSYLEKLNKEDLMRILVDPQNSIIKQYYHMFKMDNVELVFEKDALESIVDEAILKNTGARGLRSILEGLLKDVMFEVPSISKTKKVIVTKESVLNTDINPLILVGNAIKKPWAKELYEINLKYDKK

SEQ ID NO: 685 - protein, 802 aa, Borrelia garinii
MKSILNMIKNRKEDLPIVILKENVLFPNITLWVTFDNEYVINSIAQSMLEGRLILFAYPNESNYDEFGKGGIKNLCSVGTYSKLIQVIKVSKDVVKVLVECQSRVLIDSVSKKNDYLRAKVTFVPDVSGLNRELFTYSKFLKETYEVYRNSLSLKSYDSDNEPIDYFENPSKLVDIIASNSNLENSIKLELLQELNVKTRIEKLIVNLNIEIDLLDLKKDINSKVRAKLDKGQRDYFLSEQVKEIQKRLGKDENDYIDRLNSKDISEDVKSKIEKEISRLSKMQMNSPDANIIRSYIELILDLPWNENTLMKNHLSEIEFILRNSHYGMDEAKEKIINFLAVYQINSKVKAPILCLVGPPGIGKTSLVESVARSLSREFVKISLGGLRDEAEIRGHRRTYVGSLPGVFISAMKRAGKSNPVILLDEIDKINNSYKGNPESALLEVLDPEQNYKFIDHYLEIPYDLSNVLFVTTANSLNSMSKPLLDRMEIIKVEGYSYIEKLEIAKIFLIPSIIKESFLDKVYIRIEDEVIFNLIRKYTMESGVRGLKRVLTNLIRKLVRELLYKYSKDQIIKGNFYSPSSLIHGNNSLFTHDPDIPGIYKIININNYCNYVDTEYNLDLIKIDSSGFVYGLAWTNYGGAVLPVEATKFEKTGDIILTGSLGAIMKESAQLAYSIVKTYSSKLNFDIKESPEIHLHFPEGATPKDGPSAGITIATAIASILSDKKVPLDLAMTGEVTLKGFVLPVGGIKEKVLAAYRNGINKVILPKDNKKDYFKLPEEVKDNIDVKFVSSLEEVFDYLNII

SEQ ID NO: 686 - protein, 695 aa, Borrelia garinii
LFKILVLRKSKTLGVLQIIGLIILFYFSIISPTNLNADFEYKVVKGDTLFSIAIKYKAKLNDLKRINKLNVDNIRVGQILIIPSDSNLDQNITHKVNNSFNSLESVKKGVILYTTKENDTVESVSKLVGISQEEIIAWNDLRSKDLKVGMKLVLTEPDFLKPYVVKKGDSLSKLAQDFDISSKDILKFNFLNDDKLKIGQRLFLKKATESVNFHYVKKGETLGRIAYIYSLTARDLVALNGNRAVNLKAGSLLNVLKIVNNDLEKPFEKDLKIEEKTGNQFIYHSVAVGETLYSIARHYGVLIEDLKNWNNLSSNNIMHDQKLKIFDKKLLLDSSIIKSKNDSDIKNKVDSSANSSNKVQTIVNFPSSKNKKLNLNTFGTTVNQDLFDISSLVILDSKIPIFEVVGDFYYWYRPKKISQPSEFYSEDWHSPLNSYKKATQLFKSFEKLVNSRFNKGSRLKDKLIILDPGHGGLDPGAIVKSRDGLGNEVFVVEDEYVYDIALRLYVYLKQEGANVELTILAPDHLIRNSVFANNTFVNVKNEIYNDYDLNKNDTVDSWISGTPSGLKKRLVVVKNIVSKYKNIKDKDIAFFSLHADNSVGAPKSMGFYYQKDDEKKYDIHSKSVAEKITEGMKRSFYIKGQNLHVLRNNIVMTKLLIEVRNLAFPEEAWSIRSSKLRDQDSKILANGILKILENN

SEQ ID NO: 687 - protein, 562 aa, Borrelia garinii
MFRKLKKSKTYIIIISITKFSENNLLSIISNIKYLIEHKQLAYKIHWTFPIYFFEILREHEELNKWLFERFKTNKDIYMPGTYSGSPHEYMLHDEIHLDLYWALKNPFRSGYKDIFQNTPIMLYIYNIEKFRKKVTELYRKLNFNYTEGIRQSKNNKTYLIFYKNNCQYLYEVQKIDSPKSNVETLIYFYEIKESYDNQELKNFLLYLKALENNLHSIKIQNLEGSKLTAELLEIPKFNSLKEQEPIINFQNKRLKDYQINEKSLREFLINKQQEEIVKDLESIAPKNLEYNMEGNFTLSHDQYNIKFENGKLNKIKFKDKKVEFLNTSRTYLKVLSKKELIREASIESSFSFSNEKILGIKQYLAFNSATKSTIDFFIDETIPSFFLSIKIKWPSKINLDKKTLKKCNPDYLLEYSALEIPIFEIAKGTNLKITAKYSDLDTYEKIIITKNNPKGYINGTEFLISKGNDKNSNFFISFLNVEKQIIHTINYKIEKINSKKWLILNIGGSYNTVKIQDVINYSQTLNLMILPLNNNFDNKIKLNSKIKNLIFYTNIKKYENK

SEQ ID NO: 688 - protein, 545 aa, Borrelia garinii
MAKDIYFNEDARKSLLSGVEKLSNAVKVTLGPKGRNVLIDKKFGSPTVTKDGVSVAREIELENPFENMGAQLLKEVAIKTNDVAGDGTTTATVLAYAIAREGLKNVSSGINPIGIKKGIDHAVNLAAEKIRQSAKKITTKEEIAQVASISANNDSYIGEKIAEAMDKVGKDGVITVEESKTFDTTISYVEGMQFDRGYLSPYFSTNKENMSVSFDDAFILIYEKKISSIKELLPVLEKVLGTNKPLLIIAEDIEGDALAALVLNSVRGALKVCAIKSPGFGDRRKAMLEDIAVLTGGVLISEELGITLETVEIEQLGQAKTIKVDKDNTTIINTGNKEQIKERSELIKKQIEDSTSEYDKEKLQERLAKLVGGVAVINVGAVTEVELKEKKHRVEDALSATRAAVEEGVVPGGGSTLIEVAMYLDTIDTSKLSYEEKQGFEIVKRSLEEPMRQIISNAGFEGSIYIHQIKTEKKGLGFDASSFKWVNMIESGIIDPAKVTRSALQNAASIAGLLLTTECAITDIKEEKNTSGGGGYPMDPGMGMM

SEQ ID NO: 689 - protein, 248 aa, Borrelia garinii
MYKLVLVRHGESEWNKENLFTGWTDVKLSDKGINEALEAGLLLKQEGYSFDIAFSSLLSRANDTLNIILRELGQSYISVKKTWRLNERHYGALQGLNKSETAAKYGEGKVLIWRRSYDVPPMSLDESEDRHPIKDPRYKYIPKRELPSTECLKDTVTRVIPYWTDEIAKEVLGGKKVIVAAHGNSLRALVKYLDNLSEEDVLKLNIPTGIPLVYELDKDLNPIKHYYLGDESKIKSAMESVASQGKLK

SEQ ID NO: 690 - protein, 341 aa, Borrelia garinii
MKMKAKSILLFLLSTALFAQETDGLPEGSKRAEPGELVLDFAELARDPSSTKLDLTNYVDYVYSGASGIVKPEDMVVDLGINNWSVLLTPSARLQAYVKNSVVAPAVVKSESKRYAGDTILGVRVLFPSYSQSSAMIMPPFKIPFYSGESGNQFLGKGLIDNIKTMKEIKVAVYSLGYEIDLEVLFEDMNGMEYAYSLGTLKFKGWADLIWSNPNYIPNISSRIIKDDVPNYPLASSKMRFKAFRVSKSHSSKEQNFIFYVKDLRVLYDKLSVSIDSDIDSESVFKVYETSGTESLRKLKAHETFKRVLKLREKISMPEGSFQNFIEKVESEKPEESSPKK

SEQ ID NO: 691 - protein, 467 aa, Borrelia garinii
VQIKEIYFGPKILDDKNCNSKLTNFDFKVVSFELGPDHYLVDIMQVKEIRKSSNFTYVPNVKKYVAGLDNLRGEIIPIIDLRIMFNLEFNKKDLEDIMVLKNEDLLIGVIVDKINNVFSIDSSLIQDPHPVLSQDSLINYIKGVVDYNEKLYILLDVFKIFNYSEEEKVLKPGQNSAEKIDFVSDSDDLDVLDDCKGNFVTNNVFPKNSNNNENSTLKNISTFNLENIKKNLLKYEFNASLVNDVFLEKVGVKFNMVDTDCLPYDIFLNEFYSKSSGSLWGVDCLEEFQNEIVKNRLNFMDNLNSIFNVLEIGCGSGRETIALVNALSEYYVKPFKLTAIDNDLSKVVETSRLIFSESEIGISEIYRRNSFEQSPGVYKFKSEILNNVLFEYSDALFSDLPDNLGMVFLKDVLCFLDSKDQILILNIIASKTIKGALLVLGDNEELKNNDVFIKEKSAKYFNLYRKV

SEQ ID NO: 692 - protein, 753 aa, Borrelia garinii
MLVKLKYRFVGFLLLFLIFILLLFSMIFNFVLCGYLEDYYKQLTRAQLRRAAFSTQSFLDTLYVIINGAASNLALETISEFAISENRGKDFSESELVDLRKNSKFVIDSVKVNKKYRQYLYNFMTNLKNDTLFEEFAFFDFEGRIIVSTRHENNMDFGHSEANTNYFKKAIEDYKQNQLKFIGWYSNLSEGISAEVAIRSRQSEKKAFAIIVPVYSPEDKLVCGYLAGYLLNDVLADSFDRFRFGFYKRGNFVYIDSNNIAVNPFEEYNETSRVSSKFLNILKDVFSKPPLLSNIPTEVSVYTIDRILFSEMGEECYYALLPISSKLGEKGGVLIARLPYKDIYGVISSLKFQYILYSVLGIISLSIVLLMRIDRIISFRLNAIRVLVQDMVKGDLDKDYALDDGDDYFDELGMLSLQVVKMKKAISVAIASVLRNISYVNKASLEVASSSQNLTSSALQQASALEEMSANVEQIASGVNMSANNSYETEQIALKTNENSQIGGKAVEESVIAMQDIVEKVSVIEEIARKTNLLALNAAIEAARAGDEGKGFAVVASEIRKLADLSKISALEIGELVEDNSKVATEAGVIFKEMLPEIEETANLVKKISEGSSKQSDQIAQFKMALDQVGEVVQSSASSSEQLSSMSDKMLEKSKELRKSVLFFKIKDSKIENLEDGDYDFRLMDCPENSFKDENQDLKGNEISTLNGSRHSNYSLSIESEPSARTINKRVDPKKAIDIADKDLNFDDDFSEF

SEQ ID NO: 693 - protein, 317 aa, Borrelia garinii
MDLISFSVPGNLLLMGEYTILEENGLGLAIAINKRAFFSFKKSDSWRFFSKKKEIDDFSLIENRNDLVFKMFSYLSQNCFLNLESFAYDVYIDTSNFFFNDGTKKGFGSSAVVAIGIACGLFFIYNATNVVEKDEIFKYCLEAYRHAQGGIGSGYDIATSIFGGVIEFEGGFTPKYRQLGSLEFDDFYLMRGLQAVKTTASIYEYNKHRDSILDFIFKCNSEMKKLVLSVSTSKSALISSLRRAKELGLAIGEAIGISAALPPSFEHLQDQCDLIKALGAGNETFLVFRPNIKAFDLSKIIPIVLEHENIKFESEKC

SEQ ID NO: 694 - protein, 593 aa, Borrelia garinii
MEYLQTAASIKAKFDIVAIVEQYIKLAKSGSTYKGLCPFHAEKTPSFFVNSLQGYFYCFGCKKGGDVIGFLMDMEKINYNDALKILCEKFGIYYNDLKINRKSEKKSENKDMVSKIYSLNSRLINTIKFFLNKNKKALDYVLKSRAISKEVVDLFELGYLPFSIKDGLELHDFLVSKGYSSEILRKSGLFSKTNPKASILSQRLIFPIKDFKGNVVGFGGRDLDGKGSKYINLSETEVFKKKELLYGFYEGLNEIKSTKSVILVEGYIDVLAFFTSGIKRAVSTLGTSFSKEHLALIQRYANEVIFSFDGDDAGLSATLKAYQICLPFNINVSVVKMDFGLDPADLLKDKGEGSLQKILNNKCDAFEYLLDAYSNKYDLNKTVDLNAMINLFLNLINLSKIDTQKKIFLDKLSNKLGVGVTTLLKDYYRIKERFVVDNNKRNLYAHNDDSYERYLIVALLKNFSYFGIIRRNIIDSDLSDINARKIFMCFEDLFENNKDFSLMDLKRNLKDSYKVSEFFFEEILNSGFEIDDEALIHILIAIKRRKLDSRVLLCKKKIDGDSLVNAKIQINELMFLNMQRKNLKIYTDDVPGS

SEQ ID NO: 695 - protein, 225 aa, Borrelia garinii
MTNLIFKENTIYSSKFDDIYYNPKYGIEESFYTFIKGCNLDLELKTKENILIAELGFGTGLNFICLLKFIKENNITSKINYYSIEKFPLKKKTIMQISKFFVKETAYFKLMLKHYPKIPKKNLKLKITENVNLKILIGNAKIKIKEIPKNVEYWFLDGFSPKKNPEMWNNEIFNLISQKSSPGCKLSTFSSARIVKDGLKLANFKYIHIEKGFGNKRHMIRAQKN

SEQ ID NO: 696 - protein, 693 aa, Borrelia garinii
MKKMLLIFSFFLISLNGFPLNAREVDKEKLKDFVNMDLEFVNYKGPYDSTNTYEQIVGIGEFLARPLINFNSNSSYYGKYFINRFIDDQDKKASVDVFSISSKSQLDSILNLRRILTGYLIKSFDYERSSAELIAKVITIHNAVYRGDLNYYKEFYIESALKSLTKENAGLSRVYSQWAGKTQIFIPLKKNILSGKIESDIDIDSLVTDKVVAALLSENEAGVNFARDITDIQGETHKADQDKIDIELDNVHESDSNITETIENLRDQLEKATDEEHRKEIESQVDAKKKQKEELDKKAIDLDKAQQKLDFSEDNLDIQRDTVREKIQEDINEINKEKNLPKPGDVSSPKVDKQLQIKESLEDLQEQLKETSDENQKREIEKQIEIKKSDEELLKSKDPKALDLNRDLNSKASSKEKIKGKEKEIVKEKSKVSLGDLDNDETLMTPEDQKLSEDKKLDSKKNLKPVSEIERVNEISKSNNNEVSKSSPLDKPSYSDIDSKEVVDNKDVNLQETKPQAKSQSTSLNQDLITMSIDSSNPVFLEVIDPITNLGMLQLIDLNTGVRLKESTQQGIQRYGIYEREKDLVVIKMDSGKAKLQILNKLENLKVISESNFEINKNSSLYVDSKMILVAVKDSGNVWRLAKFSPKNLDEFILSENKILPFTSFSVRKNFIYLQDEFKSLITLDLNTLKKVE

SEQ ID NO: 697 - protein, 337 aa, Borrelia garinii
MTKPKISSINKEKIKILTILVLTSTFLLGIIFSNENKVARILEEKFFDFDLNLISKIETELEGTLTKLGKDWMLTYNKQNIPVDNKKVNALIRALDELQKNKLVSRDQKKHKELGIGENPSFKLFDNNNKLLTEIFVGKPGEGDSRLAYIKGSSENVYLTKNIFLSYKGNSYNTFSDTTLFQEKNTKLENLSFKIIRKLNKENENNINNNYEITTKDGLYFLNNQKMLKERPLNIIAEFKADGLEIDKSKINGYNLQYKIEVKWSNKSVNNIEVYFNKNEENDKDILIKKDKDEYYYMTSKWTFFDVFNLEKKIIEKDNISSNDNQEDEHEHHNNAD

SEQ ID NO: 698 - protein, 307 aa, Borrelia garinii
MINVEKVTKMYGSFTALLNINFKVEEGEVLGILGPNGAGKSTLIKILTSFHYPSKGNVKIFGKDIVEHSKEILQQIGYVPEKLALYPELSVKEYLKFISEIKGVKKIKKEIDKVISIFKLKEVEDKLISQLSKGFKQRVGIAGALINNPKLVILDEPTNGLDPNQIIEFKEFLRELTKESTILFSSHILSEVESICKRIIIVNNGVIVADDTKENIIKNKLKEIEIELIVLKKSENEKKIFNSKNDIFTLIQLEEHEKDLNISLKLSQGKTEEDLFSYIVKNNIILKAMIPKHESLETIFSKLTKER

SEQ ID NO: 699 - protein, 109 aa, Borrelia garinii
MKLNEYQEKAKKTAKYKNKKEELILTTLGLAGETGEVVEKIKKLGRDKNYIIDDEYLISIKKELGDVLWYLSTLSNNLGITLEDVALTNLKKIQKRHENGTINGEGDDR

SEQ ID NO: 700 - protein, 348 aa, Borrelia garinii
MTILPKIAKDIIKAYDQKILPNAILLLGEKFSSKKTSAIEIAKKILNEKNLTNPNLLIFANLDTIEAKAHLSTNSYKIINKYLEYIKTVIFTKCYFSNEKNLKKIEKNINYINSVYYKKEYNINIKNEFIKNIENINKELNRSITVYDVKKIQTWIFSEKEKPKVIYINEIENLSFNVHNSLLKILEGPPSNIYFILAARNKNKIPKTILSRLRVYNFTKPEKRLGIQIFKESFLTNKDITIEEYFASFYEEESKKIKKELIKILNIIKEKKSIFNLEEIDFIKDDQSFKIFLNELTINIRKDFLENKIDINQYLKYTEHLKNIYKYRPYNQNKKLIIENLMLNYEEI

SEQ ID NO: 701 - protein, 331 aa, Borrelia garinii
MNKLMLIAFATTNLLAQTNKASTDLKAEQSFNDKLSESVKLKEIANICPTNTNFLTGIGIVVGLAGKGDSLKQKDLISKILKENNTIDEISPNSIESKNIALVSVSLQVKGNAIKGSKHKACIASILDSKDLTNGILLKTNLKNKEGEIIAIASGIIKTNGKLKGSEYTLDSIIINENQNASYSYNIILEKGNYTLINRIHKILTSKKINNKIKSDNIIEIEAKNMGLLEEIENIKIETNPKVLIDKKNGIILASENAKIGTFTFSIEQDDQTILNSKTKTTIQVNSMKLNEFILKNSNNLSNKELIQIIQAAKKINKLDGELILEEINGS

SEQ ID NO: 702 - protein, 394 aa, Borrelia garinii
LRKDLIFLVLIVLIIASVVIFFIRSSKKELVYFELNTKNNISFLFLVEDLNKNLVSMQEIFINIKTGNLGFLDIPIHTGYEDLKGNISWFKDLYKKNSFTKFLSKIHTQLSHESDYYIRFQKENFVKLIDYLGGVRLLVKNPVKVYSFEDSILIPSGTSNFDGDKAYDYLRYFNDVNQFEERVEFFKEFFKKLLFQISDFGIENDNFFKIYSMIDTNLSEVVFKYIFKNYKINNDKIISINIKGQEEIFKDNHNNLIKVVLPEYGGAILKESVDKLNKELVNEGPEEIVKIVVLNGTKVAGLAKKTANIFNSLKFKVLNFDNADKNSYKNTLIINNSDNLEMAVRVGEVIKATNIKPISEVQTKRLLELDNLDINPDVIVVLGDDFNGRYVKSK

SEQ ID NO: 703 - protein, 639 aa, Borrelia garinii
MNGNNNMNNNGKSNNKKKNKNWILGFVVIFLISAIFMSYFIRGGESYKNVPYSTFQNYLDNGLVESVVIIDKNLIQFVVKGSNFAKSYFSTSIPYLDINLLAELKNKKVELSSGKSQASLIGVLLQTLPWILFFIFFFFIFRQTQGGGGKVFTFGKSNAQKYEAGKNKITFKDVAGQEEVKQELREVVEFLKNPKKFEKIGAKIPKGVLLVGSPGTGKTLLAKAVAGEAGVSFFHMSGSDFVEMFVGVGASRVRDLFDNARKNSPCIIFIDELDAVGRSRGAGLGGGHDEREQTLNQLLVEMDGFGTHVNVIVMAATNRPDVLDSALLRPGRFDRQVTVSLPDIKEREAILNIHSSKTKLSKDINLQVIARATPGASGADLANLINEGALIAARNNQDEILMKDMEEARDKILMGVAKKSMTITDRQKLETAYHEAGHALLHYYLKHADPLHKVTIIPRGRALGVAFSLPREDRLSINKHQILDKIKICYGGYASEQINLGVTTAGVQNDLMQATSLAKKMVTEWGMGEEVGPIFLVDDEAPIFLPKEFSKAKAYSENTADKVDREVKRILEECLKEASDILVKHKDQLVKLAKELVLKETLTDKEVRELLGFEVSKDECDLFVVESIAKEVEGEDKKG

SEQ ID NO: 704 - protein, 1466 aa, Borrelia garinii
MNLGFLRNKTFLLFTLPFFVFVLIIFSINLFVQIQIYSAKFFVVKYLESKFGFRIKYDKISPYFLSSIKIDGLELSLYGKDKILMDVVRVDLNLFKLILGDENIILNVYVKGSNLNFDINDFSISNDLNSSSAYDNENVILNKIINYLYRLNINLENININIKLNKNNSWLNFKVKNFSLSTVDEDFLFSSVVDFSAVKNLEINLPSERVDDGILDSTFYFEGKFKKGFEDGYVNFSFFEFKTKYFSLLEQGFQINYSKGNLKIFNLRRENFDFNLSYDKANGFIRLDALFFNVNLLDWINLNEDFEVYKDYFDISLNGQLAFSYDFKDKDLRYAGIIDSSLNVDTIGKEIQGLQLEIKGDDSIVSVKNAILKLKRGVVTYKGYYSLKDLLPIGRLNFKSSKILNFNDLNGYLDFKKDKNIFSVNSDNFSLGNLNFQNLSLKTYFLKDKIFIDYLIYLENKNSQISLKGDLKDEEFAFNLGIKELPLLFLKEVIPSSYLINFFPRTLLSGKYLNLVSDFNLNKFDYHKNRLKTFNFMVFSKLDNFNFIFDASGEKNFYKSNNFELQYNDHNLHSSLFIELFESGFNISTNFSYLDKNYPLHFNVNLKNKLIIAESPLGIKFNLNYFDPKIIYALNVNGFKVCNKTSDLLININFNGSYLGLNDDLKFKIDKFNIVKASKIPSYNFNFGFKGLYEYDKLHIFDVRLVNKLSNLQGYGQFNLKDNLNGSLNLFSSLNSERYFLGINSDEYGSYFLLKFQDLDFYNFNSLSLLEGKVNGNFLLNFKKNDLKNYSLSGYLEADKLTLLGIPVQLSLNLGLLDNKLNIYDIKAKRNKKEFLTGSLRYDLSSSIGVSNMVFSSNLFSYKFNANFRNFESRDEERFGVLKTKIEGEFSFRDIKYKDEFLSNLTVEFSNDFEKFNMTSIDYDLINVLYHYSSGEYSFILKDYLPLSFNSSGKIIKNKILGNVRDIKFDSKIITKDFLDSHSLFNIDNHFILYDLVLNGEFDIDGDLYNPNINGILNIQKGLVSTEYLRASRKFGGDRALEIFDMPVEIQDNKIIFSNEFNLDRYSKVFVSTSLNLNFLSDTIIDYYKIDISVTGRTGVPIKFDKIALSFTGYALGNFSIEGNADEIMFKGILNISNAWVYSLEGSIVNLLVNPFKQTKRVQTVDVNVRDFDILTDLEINFDSGVTFHWPDSNISFLQATISRGDKLLIKSDTKTDDFILKGDLNIASGFVNYNNKKFIFKSGAYISFNESRAKFDPWIKAEATNTIKDRNDKLLVTISIDSPLSLWKIEFMSYPSRTEQEIKYLLSGSTMGEAEGGLRSAGTNAAEMAIGIVSDIALDFLIQPIEDYMRSVLNLDLLSIKTDILKNSINSNFFKIGNPTFVDVLDNTSVKVGKYLVEGVFISGGFGFLKEQMTPFSKDLNFVINLGIEFDSPFFLVNYEFDYNFMKKGLDGIGNNIGISWKFKY

SEQ ID NO: 705 - protein, 177 aa, Borrelia garinii
VFFLILPLFFLLSFNVFSIDVIKIGIVDFDRIVIEVLNPQLKANLDQIKNRYQEQINTLNLELKNLRQLYDKSIADNDLDNARSFGNQYNLKVDELKRLSSLAKNNLEQQRLANINSLNNNSESLSKILHGIQYVAEINGFSLIMKKNNPYILYHNSTVDITDSVVKYLLEKDNKNP

SEQ ID NO: 706 - protein, 274 aa, Borrelia garinii
MLKILTKIIAISCLMVGCTSLSYSPPKQNLNYLMELLPDANLYAHVNLIKNRSIYNSLSPKYKSILGLISDLYFSYKKENNDFALLIMGNFPKDIFWGIHKNRNIESIGNIFTSPKWKLKNLNIYITPNKARTSITINQKDKTLKENNILTTKYIKEVEKNEMFFWIQDSILLLPNQIASSKNLIPFSSGTLSINSLNQKEYILKSLLTTNNPSILKILSKKLIPTILTSTTNLTISSHIKATIKDQNTVEIEFNIQKSSVENFIAKLASNIQT

SEQ ID NO: 707 - protein, 313 aa, Borrelia garinii
MKKNILATYILILVSLLSCNISGPNELGNKKTEKKGGGEGVLGFIEKIQEESIKGVEQHIEKREKQTMQTVSVKPVNVNRNFLYYPQEEIEIKEEALIPSTDEEKRVDKAISDGRLEFDKLVYDENKLKNESEQLESNFNNVYDEISKLKDAIQTEAHIVGRINHIIKTRPEKREYQNRVRQNQSEKRTLINLFNQLLEKRDDIEELHTQLDSGLSERASAKYFFEQSQKTLKDAITERLKNENRSWSKRSYGGNLTRKANREIDNALEQLKTSSSKIIKAMEIKGRIEQLLQEVKSLLASSRSKILTGFFKK

SEQ ID NO: 708 - protein, 172 aa, Borrelia garinii
LKQKIIIFTILAFLFNCTNKNNNAALNNDLDEESQKLQSKSNLVNDNRVEFSKTTPLEKLISGLNLNDAEKETLAFLINSLKEKLADSNIGVNFKNTGGDESKIEETVHKFLSDLKEDEIKEMLAKIKKNKDKKEKNSEELNTYKNTLAGGFDGMFNKTDSKTTFNNLKDAA

SEQ ID NO: 709 - protein, 273 aa, Borrelia garinii
LTLIFGCSLDNNSKIGKEGGRLIGGNESDRLGQKKRALDSMNFRSLSDGSSLVSDSQNHETLKALENKNKIIDYSQIQFLEGTKSISVYLWPVDIRWIKIKARDLFNERGNSIKELKGIKYSYLVSPVSGSYISYAMPLIIFETTCESDPIYSVSGFKLISKGSNINFNENKGGFLVGLPMSEKSVESGLVTAYPFGSNNAKKVVEAFTSLYSNGVWSDMIAEITIKFKKPPQTEKVYRISLDSKLFNVAMKKIVEKYPQIKSASFAFNSLIN

SEQ ID NO: 710 - protein, 190 aa, Borrelia garinii
VYSIVKEDHMDIKINKRNLSESIREEEQALIHYNKLKEKLNINFQKEIYCKLEAMKVLKEIKDKEYYKLDNYSTFDDFAKDYRLARTQTYKYLKIATAIEEGLIEEKYVVKNGINETIYLLKTKEGPSLRKSNQNPIKPLRFQLKKEESYSFYKKNAKLTSFLLEKIFFEEKDFLLKIIEEFETLRSKRK

SEQ ID NO: 711 - protein, 175 aa, Borrelia garinii
MTKYIKNLLKLTLIVGLLVACSLTGKARLESSVKDITDEIDKAIKEAIADGVKLNELEENKTGAKKGGPQIRDAKIRVINLSVKFLKEIEEEANILKDNVGMNKVDKDQLLKDMYDLMLNAAGSLQKLGLQEMIKTVTQAAEKTPPTTVEGILMIANTIEDKLKKIKGKQETNKK

SEQ ID NO: 712 - protein, 528 aa, Borrelia garinii
MIRKKILLLTLLIAAASSCKISKTKEDLAFGVGIGNEPSSLDPQFCSDKLGNLIINELFIGLLRGDPKTGGYRPGLAKNWEISQDNTSYTFHLRDDIYWSDGVKITADAIRGSYIMALEAEENLPNINLLTSKIKNAKEFHTTKLNSDEVGIKVIDEKTLEITLEQPTEYFLDMITNPIFIPIPTHVVKKFGNKWTTPENMVTSGPFKLKRRILNEEISLEKNKKFYDAKNVDINELTFVTINDARRIYSMYEHNEIDAIFNNIPLNLINELILREDFYSSDINQIGFLSLNLNAKPLNNPKVREALSLAVDRETLVYRVLDNNFKATRKVSPNINNYNYGKKLKPYNPRKAEKLLAEAGYPDGKKFPTITIKYSKNELGKEVANFIQSQWKKVLNINVEVETETWSSHVSNILKGQYEISVRSWQGDYLDPMTFFTIFETKNSHLSAYGYSNPEVDELLNKSEFEVDKKIRLEIFKKVEEIIIENDHPIIPIYSVAGNYLFRNDKWTGWNTNASERFALSEIKPLEE

SEQ ID NO: 713 - protein, 227 aa, Borrelia garinii
MKRISILSILLLLLLFSCKQYGDVKSLTEVATDLEDDNSFASGSVESKDQIIEKGPVLTSEEFERLEALKTFLKDAMGVNGREGDTKAEYEKSYKEFFDWLSKDVNRQKEFVSFFNNICGIITKAVDASKKRYNSNPKSLGFNEYVCYDIKTRTGDDLSLFFQKVADAFGTQEYKNKDEDDENNQKPEKCNEEIFKVIKRVFTESENNNELANLKNLNSYNLNSNNK

SEQ ID NO: 714 - protein, 379 aa, Borrelia garinii
MNANDKNKALNEYNLKNISEVIKNSLQIELDFKKELEAKTNQSIPPILEIEKIEPEKQEFSLKSESESLIPLEILEEANVVKSEEEIAKIQEKLLLIGASDEIIVQELDPNIQKSLNPTTIEFKILSTADEKTILDPTEEEINTNEKDKIFDQKKENSTLSGTEKTPIQNQFQKHDASLGKDGNLITKEYAEQVRKSLDKALNAIKSLEKSKDLLNLDAENLLKDPENSKNKTNSSISNNIDTKNIEKTKNKFLEELEKSELSFEDTKDPLGISTIKEVIDAANKWKEKENSSQINWNLGSKFHPTPKLYNESVAREYEVLAEKFTKVKNEYKNTKEQLKVQPKLTANNLSKIIDATKEFANQVRNLILLVENNHQKPY

SEQ ID NO: 715 - protein, 285 aa, Borrelia garinii
MIYKILTLFKITLLFSCSFYSPSNSEEATKELQSNLIAKNFSINKAENLNNLQQSQLSKTKKERIIKKFIQRLNENEELIESIESKIEISTQKTNQDIQKIEPIDHFGINKNAFPENTGASNIDLMLKKNEARRLFYSSLDYDENKIKKLISILAKTSSSSGYHYNIIDAFFWKGFKTQESLETVVNLLTKNELRRLILNFETKTVKDIQEKFEKLMQNKNAWIKIVEEVISKYGNNTASSSVDRIILGEMIRLGYEYKLNPDESMRITEKMKILLKACCDHIHY

SEQ ID NO: 716 - protein, 365 aa, Borrelia garinii
MKEIGISIYPNVSPKNKIIEYLEKSAHFGFTQVFTSLLYINGNEFNIFKELLNIANKNGMKPIIDVSPKIFKELEIDLSNLRNCPKLDYFKKLGAWAIRLDNTFTGIEESLMTFNDSDLKIQLNISNINKHIDTIMYFKPNIKNLLGCHNFYPHKYTGLSRTFFKETTKIFKHYSIPTAAFISSSNAEECARGKEKEGVPTLESHRSKDIETQAKDLFKEGIDTVLISNCFPSETELKKVSKVNRNVLELKADLNPKATPVEKEIILENLHFNRGDINSYRIRSTMPRVYYNNKKFPVHSPNEIKKGDILIDSSEYLGYAGELQISLKDTPNNSLINVVGKIVDEEIYLLEKIEPWEKFKIIENK

SEQ ID NO: 717 - protein, 533 aa, Borrelia garinii
MFDMKMLIKKLKAILFLNAILFISCFKENDGHKLAFKLNIGSEPVTLDVQLINDSVGSTIVSQMFLGILDGDPRTGGYRPGLAKSWDISDEGIVYTFHLRDNLVWSDGIAITAEGIRKSYLRILDKETGSSFVNIIKSTIKNAEEYFDGKVNESDLGIKALDEKTLEITLKSPKPYFLDMLVHQTFVPVPVHVIEKYGQEWTNPENMVVSGPFKLKSRVLNEKVVLEKNDKYYKSKDVVLDNIVFFVTDNSITAYNMYLNDELDAIFNNVPPDLLKDLKLRDDYYSIGINSTYFYSLNTKVKPLDNVTVRKALSLAIDRKTLTESVLNDSSIPTRRATPDYIDYSYKSNLNLFDAQMAKKLLVDAGYPNGKNFPLLKVKYNVNDRQRKIAEFIQNQWKKNLNINVQLESEEWSTYINSRVNGNYEIIRAGWLGDYSDPMTFLSIFKTENTSFSSYGYSNSEYDKLLIKSDHERNIFKRQEILKKAETIIIERDFPAIFINIISSSYLFRNDKWKGWEPNISQRFDLSVIRPIK

SEQ ID NO: 718 - protein, 404 aa, Borrelia garinii
MTNKIIKEALTFDDVSLIPRKSSILPSEVSLKTQLTKNISLNIPFLSSAMDTVTESQMAIAIAKEGGIGIIHKNMSIEAQKKEIEKVKTYKVQKTININKDINEQTTKMLLEKQHLEESKIYKNAERKEDFPNACKDLNSRLRVGAAVSIDIDTLERVEELVKAHVDILVIDSAHGHSTRIIELVQTIKNKYPSLDLIAGNIVTKEAALDLINVGADCLKVGIGPGSICTTRIVAGVGVPQITAICDVYEVCKNTNICIIADGGIRFSGDVVKAIAAGADSVMIGNLFAGVKESPSEEIIYNGKKFKSYVGMGSISGMKRGSKSRYFQLENNEPKKLVPEGIEGMVPYSGKLEDILTQLKGGLMSGMGYLGANTISDLKINSKFVKISHSSLKESHPHDVLNIP

SEQ ID NO: 719 - protein, 207 aa, Borrelia garinii
MKKNTLSAILMTLFLFISCNNSGGDSASTNPDESAKGPNLTVISKKITDSNAFLLAVKEVEALLSSIDELSKAIGKKIKNDGTLDNEANRNESLIAGAYEISKLITQKLSVLNSEELKEKIKEAKDCSEKFTTKLKDSHAELGIQSVQDDNAKKAILKTHGTKDKGAKELEELFKSLESLSKAAQAALTNSVKELTNPVVAETPKKP

SEQ ID NO: 720 - protein, 68 aa, Borrelia garinii
MLKLVNYLLLALLLCCTTIASLPDEPKPPIIQTLGALAKYEAQLSDYVMYLVIFLSKTKVKVNDPNYP

SEQ ID NO: 721 - protein, 1081 aa, Borrelia garinii
MKLDEIIIPLSMSISNNQKLDSIAETLKKIAEQKFASLDNLKSKLEKSTASGSNLEKALNKSSQNASKNFKSLANSVDSVNSKASGMKSIGKVLKSVGKGLGSVKNLANKTGEAFNQMLAAFAPIIIAVKALQAIGSTISGIFDGAMDALDEFNEEVSTFSDMLGNEELGKSLAESMRAFGDETLFTRDAIANATKTMLSYGATASEVEERIRMFGEAAGGSSEGLEKLAEVYSRVESSNQVNLEDLYALRDAGVDITDILAEEAGLAGEALYKAASDGQIGFEALNKALSKATSEGGKFYGNTAKEAKTLSQAQQQTAKMSEKLFLDIGKALEPMMIGFEKVKQFLLVAIMVPLTKVTTATIYLTTKLGELVVYLSGKWLEGVKMWFKAISTPFVKLFEGIKYVFNKLKELAKYVSSVFPERFKSAFEPIIKWFQKLLDMASKAYEKFKNIITFWKKSKKEEDTPSSEPERDKKVDPNAKTDYNKKIEQDYKKLQDEIFFAQREIYSKVGVEREKALRELEKTIKKKNQKFLNTYSKRFDELSDENKKILVGVEKAVNEFNNSNYDFVNEYQELLKEKESRERKILLTLPHTDQESALQKLNDEINGKNKAFVEKYGKSFETLNESNRKIVAELEKKVKEFEKAALDRSFVEAQKALQKNILALEWETMLLPAKERASAEKKMASDIQAMYKKFVDEHKSQFDNLNETNRNALKQMAEKAKDTAKSLYDKCLENLDKFTEFTGKILNQEVGEKAGSEGFDYAADSATKGLVDFGKNTLKAVGASFGPVGQAIAEIVIQIGEFLWGWFKGAEKARIKKIEEQRDKDLEELEKRSEIELKKLEEKFDAEIAMRKEKLSELDDEYSKEIEFLKQAQSKGQISGEEFQKRLHDVQTEYKTKKGIETTKLTKVEETKKLEVERQNKFSKLETERIKAQAEVDKVNTRMWSWSKSSDLEKAQKILDEILKRIATVKSAGSIEEIKLARGGARFVSNKPTYMPNSGVMSSEFGQPELVRITPAPIDENLRKLEAKIIAEEIAKLQKSQSSTVVNNFYYNFNGNVLDAEKLVRMLKSKEHLMTFRMAE

SEQ ID NO: 722 - protein, 142 aa, Borrelia garinii; identical to SEQ ID NO: 228

SEQ ID NO: 723 - protein, 396 aa, Borrelia garinii; identical to SEQ ID NO: 229

SEQ ID NO: 724 - protein, 260 aa, Borrelia garinii; identical to SEQ ID NO: 230

SEQ ID NO: 725 - protein, 874 aa, Borrelia garinii
LEEQDNTVQGIDLESPEITGQNPEISSAKEDTTQDCTSLGFDIVFYTDEGQIFELTPFVDISSIVLEEKIVDPSLKTASSNFSFSVSGLSEDFLNFLFFRNEDIFVKVSDNKNPVFTGILEKFFSRDLFNSTKSVSFTVNDYSSLLKIAFENPVQFPINFSPDWLFVYNPLAKELSLVHLIIGKTKLKDLIDDDASEAILDKVPAVIIDCGENVETILQALLYEFGYAYTFSPIGKLKILPIWKSEVINREIEICTIDAESYVMSKSSSSSYDSTKVIWREGKFQSKEESISKKRPLYSAPINVAGNDGKLYVAVLQKGVVYPDFADKVGSSVFQEYDPSWLDTVYKWDFKRREVWHDHYAINEHLAIISTHNLEARFSADSSIKLENKEYFPTKAKLWFRNTSSSQGSKYIYHFDIYGDVFYTIAQNVIQTDNADDFYSKKFEYTTRFIFSEESAVRLFEFLTNLRVKGHTIVNFRSMQNLNITDFVKLRPDNIGIDHFFLILSKKITNFDLDIKLYEYEGITWGDYTHYEYLTTSTKISVSDYLSGVNKVVIAPFNYNGAETFQFKADGFKDEDTLNTAIEFAKQAGLNKIKLLNGDFYIYDQVNLNNLEIQGKDEVTIRSTGFSKHIFTSEKSFKLSGISICQQPLSELYINGGTLNQEELSMYLEDKSFTHPHGVVFCSSYSVKENARSSVYVTDVNFVYIKDVTFRCALNNALYLKKVKKILLEDVDFDSANQGFEISDAKNITLVNTNIKSSKKESVASGYNIMIRESSFENNNNALKLSNFSSVKILDSQLSKNKGTALHLVDITIARLNNNVFVENKVGLENHSFDLIIQDTFLKNTLALDLSDSKGRIIDSSTYSENTKDKQEAA

SEQ ID NO: 726 - protein, 85 aa, Borrelia garinii
LGTLTEYVYKFLDEWIQKKYNAKLGFTIEKVDGLEYICKAKRYASLKKILTKIFKDYKDIFLGRLQKAPGVAAVPGSTGKGQGGS

SEQ ID NO: 727 - protein, 179 aa, Borrelia garinii
MKSVLTITNVTEEQIYKEFLRLGMEQLIAQDLSKRYYHNELTYRDLENLEKQFGIKIDNLVSKIDSVEKNLNTKIDSVEKNLDTKIDGIKNEFNAKIDGLNIKIENLNAKINSVEKNLKQDMSNLAQDLKKDIQINSKLLLEKLKVSNRIIILITVLVVPIAISSMANIVMSIIGSYLK

SEQ ID NO: 728 - protein, 1194 aa, Borrelia garinii
MKTNNIVKTNDPYMSLYKKLSKDFIKKESINKPKDFFILIKNKLSSIDDNSTEANIESLLRSIFEELNYSVEQQKVGQIEGVESRVDILLFENDKYRVDFNNKLEEAKKNNEPILTKDILLIAEVKRPSFSFNTKNKVKEAEDQLYRYLNQYQKHYGILSNGKIWRLYDKSKVLYGEKRYIEFDFSKIEEKEEYKKQEWFILFIYLIRKERYLKTSNVIEIEKEEISKEKEIIQKTLREILYERPDDSIVFKIAKNIYDKEFKVSGKEITQQILASILEESIIFILRIFFIAYIEDNDIFKKILEENKLYRSSISFRYFFYDENTKKKLGYKKIITIFNLLDKGSDAIKFPIFNGGLFAEDKVKYLNNESLLSISELEEVLVKILFFEEKNIKDEKFVEYSKLDPKSFGELYETLLEYDLRIADTTVHRIVEDEVYLIRTEEELENKKVNKVATYYKGNIYLTSRSLNRKKSGAYYTPDDLTDFMVISSIEEQLKTKAPLDIKIIDNSCGSGHFLISCLDYLTEKVWYQLDKFEDVKKELDKEYRAILKESEEYDVQDSISKELVLKRMLLKKCIYGVDINPISVEITMLSLWINTFIFGTPLSFIEHHIKVGNALLGYTKDEFFDITKKKFEGGFSLFKKRIKEITTILEDSYQKIKGINDTTKEDIEKSKKIYKEYEESEDTDNLKIIFSLLKLYSLSFDKSLNIEFSDIATVISLIENILRNKTSSEDKEKIEIIRKLSSYYKFFHYGIEFPDIQEGFDIVIGNPPWEKIKFNESEFFSKHIPSYRKLSIKEQNKIKEEILSKDTHPLNIEYNEEKNSISTINNIYKFDFKDYTSGGDPNLFRYFVTFNLKLIKEKGNLTYLVPSALFSESSSRSLRKHIFSKYKLNYIYQFENKKRFKDVDSRFKFVIFQFSNIKESTSSFKAKFMIQHSDNILKEITRDLKDNKDDPYKGIELNIDQIKKLSPTQESIIEFKNNEEFGLINKMFSQFSVFSEEYIDFKKGLDTSIKNRKSLLKEYDNENFIFLYCGANIHQFNSRFFENKNAKESSKFFWIDKEDLEKILAENNQHQTERIFYRAIARNTDIRTMISTLSPQNCYCVYSMYINYEKTPISIYKKLFIISILNSLAFDFLLRRFIDSNVLKSCLYQCPMPQPEEKEILSNSLYLNLAKNTSILIAKNDPENFKYLLYLDI

SEQ ID NO: 729 - protein, 250 aa, Borrelia garinii
LKKTKLNIIKLNILTTTLTLICISCAVNKIDPEPKSKTNKKENTKEFKNKSQNPDPLKTKNIEDIISKLKAIGKDLEAQQKQEKIEIDKIAAAQLDFLDTFKVGPRDLIVEENQMKMKRIIYSSLNYETEKIKILQGILEKLKQNPKAHNILGSFLYHISWGIQFNIEECLKGIRKAITDELHTLGQEKAERLLMQIESSLKLKQRFAKTLKETIEDYNKNLENIQTDAEKLVNHMNENYKEHDSLKPIY

SEQ ID NO: 730 - protein, 354 aa, Borrelia garinii
MKVKSKYLALGLLFSFISCNLFTRDEIKEESPGLFDKGNSILETSEESVKKPINKQGKSKVSRKQGKNKVSRKEPSIHSLKKGLCYKSNLLQKNVTLEEESLKTELLKEHSKTRKEKIQKQQDEHKGMTQVSLNSLSGESGELEETIERNEIDLTIDSDLRQKSALQTISGSNSISYTDEIEEEDYDQYYLEEEYDEYDYKEIRLSNRYQSYLEGVKHNVDSAIKTITKIYDTYTLFSTKRTQMYSTRLDNLAKAKAAEEATKFTKEDLEKNFKTLLNYIQVSVKTATNFVYISETHAKGKLENIETEIKTLIAKIKEQSNLYEAYKAIVRSILLMRDSLKKVKGAIEKNGIWY

SEQ ID NO: 731 - protein, 319 aa, Borrelia garinii
MELFDENYYAKAVANIIGEVKDPIMYKWFLPDQIEDVDLKMGYQRTVKWDTFLNANPTTIANEVNTISTIGFSSQVVRINYLKLQYKFRHLKQTAEKFYTADSYIGDINNNLLPFAQAYKLASSEIIKLINHFVLTGTVSIQKDGKNQKRLLPNMYGLLNMPDQVKEEVTSGDKDKMDKIFEKIEAGLSKLELGDEFSTPMMVIVDPATSLKLVKPYTIAQAPVMSCEKWEDVLIQTIKAINNREDVYIETSNLLKHQILIYPLNPALIKFKPSKYMLPTPNEQVDKDSTDIAHSYIDFVLGGLLATKKTILQVDIKQS

SEQ ID NO: 732 - protein, 87 aa, Borrelia garinii
MESVLATNITEEQIYKEFLRLGMEQLIAKDLSKRYYHNELTYRDLENLEKQFGLKFDNLDFKIDTVKNELNTKIDNVEKIFKMIYLF

SEQ ID NO: 733 - protein, 185 aa, Borrelia garinii
MSDITKIKQEFDKKVAEIKALMKNPQQDTGLLSNSVDFRDKNLIYSNSGGVWTSSKDKIENYPAKGYPYKRGVKLSFSEDGSSEFEVEAGGGDDLYGVCTDIDEFSGIATVIPITNNFMGYLTFKKNGNGLNPGDKLHFNQHGELEKTTGAQKTVNAIALSKVHKLTEDLHIVLASVFGNRAIKG

SEQ ID NO: 734 - protein, 259 aa, Borrelia garinii
MSDKDKRRLEYKELAKESKAKSKMLAASQGKGLVAKIAIGSALGNIIGNAMSKAAGGLLGFAKKAVEEKSKTNRAKLLNSAFFEKDERNTIMGTLKGMKGFERDLEKEEFLNQASVFKGTLRDLGMLNLTNLKKAVEFSAALKSSGAMSGEDAVKAVNSLLSGEGDELFDLLKKSGVGDKYIEDAKKAWQSGAEVDLESRITMLVEMFKDFKSFGITKKADTKEEIDSNLASAEQTLSNLTTTVLDPLLKFIKMVTGLS

SEQ ID NO: 735 - protein, 353 aa, Borrelia garinii
MNGKMRMFIICVVFTLISSCKYYASSEDLKNLEQNVKGKVKGFLDTKERIVSDDPTVYEIAEKLKEEELKGKKENKENVNLENKEKKEDSNKNDLKDNEDAKVLKPELEHIALENKKPKLEIAEKILKPEIPKLPVVPVVVKPVVKEKTEEEKARDKEYEDLRRRRIEQYQKQEEERLKRKAEREERKKLRESSGTFLERATKGKILTVTKQLDKIIRDIYSINPGSSFEERMEVSGKEVEDKVTGAIYDDITNNNSSGNSIYSEWEYDFDEESLLKSLIEELEKARTALRSKIKEGNENKNTVIISDIKGDLEKIKDKLKELKEYLQSNANKEEIQKLVKCSIDPNSDGCQE

SEQ ID NO: 736 - protein, 117 aa, Borrelia garinii
MNNLAYRTYNIESIKNEFLNIGFSEEAIDFVFLYNDNYNFEYLKEKIIDVEKNLQKDISNLDVKIDNVEKNLNTKIDSVNTKIDFVEKNLQKDISILDTKIDNVEKNLNTQIDNVSS

SEQ ID NO: 737 - protein, 227 aa, Borrelia garinii
MNKKMKMFIICAVFALIISCKNYATSKDLEGAVQDLESSEQNVKKTEQEIKKQVEGFLEILETKDLNTLDTKEIEKQIQELKNKIEKLDSKKTSLKTYSEYEEKIKQIKEKLKDKKELEKKLKELEDSLKKKKGERKSALQEAKQKFEEYKKQVDTSTGKTQGDRSKNRGGVGVQAWQCANELGLGVSYSNGGSDNSNTDELANKVIDDSLKKIEEELKGIEEDKKE

SEQ ID NO: 738 - protein, 144 aa, Borrelia garinii
MKIINILFCVFFILLNSCNSDNNDSFNKNNNREVKSIKKRDLSETEKAKSPEELLREKLSEDEKRHLDWLKTALTDEGEFIKFLGNDESKIKGALNHIKSELDKCTGKNEDHQKTIFKQVVEGALKEGIDSFADQASSTCGNGN

SEQ ID NO: 739 - protein, 184 aa, Borrelia garinii
MRILVGICIITLALLSCYLSDKQEQAVQTFFENLEMESYDKGPDEIITEGKFSNLRLYVAEHRLLVDIKKTIISLKDPNYRDVPPVPDYNEEYFNKFFLDLGSDRSKELIKLFGRLKNEQNNKFKHGVYWLYSCIRDLYSPDIKYSGEGGHEYWYNGREVFMPRPTIDQQYFKVKEVIEQYALR

SEQ ID NO: 740 - protein, 111 aa, Borrelia garinii
MQNNIISLGLNLLSSLTNIAKTDTNIDHNYINTFNKVIDFFYKTYMSTLKSMETAESTKILEEIQDILKYNIEIIEAISNNKSNKIISSLKVKRNKIMREYISILKRGENA

SEQ ID NO: 741 - protein, 231 aa, Borrelia garinii
MELVSTKNITEEQIYKEFLRLGMEQLIAQDLSKRYYHNKLTYRDLENLEKQFGLKFENLEFKIDTIEKNLNTKIDTVKSELNTKIDTVEKNLQKDIANLDAKIDTVVEKNLQKDIANLDAKIDTVEKNLQKDIANLDAKIDTVEKNLQKDIANLDAKIDNVEKNLKQNLDEKLKINNQFLLEKIEINNQLLSKNLDSSNRLITIMSIVLVPIAIAIIGPFVLSLINGFFKQ

SEQ ID NO: 742 - protein, 58 aa, Borrelia garinii
MNNLAYRTYNIESIKNEFLNIGFSEEAIDFVFLHNDNYNFEYLKEKLIDVEKNLRKDI

SEQ ID NO: 743 - protein, 173 aa, Borrelia garinii
MEIILNKRNLEVLNEAEEHYKKLKQRLKSSFQQEIYYKMEVIKILKEIKDNEYYKLDGYRTFEDFIKDYHLARSQAYDYLKIANAIKDGILEEAYVIENGVTKTLEFLRKSPNVLKKSKQNPIKPLRFQLKSQESYDFYKSNAKFTGYLLDKLFNNEKEMIKKIMKEYKQLKG

SEQ ID NO: 744 - protein, 180 aa, Borrelia garinii
LDIKVNKRDLSNNGNYIIADSALNHYNSLKEKLKINSKKEIYCKLETLKILKEIKDNEYYKLDGYKSFEAFSKDYRLARAQVYNYLKIANAIEDGVIQEEFLIKNGILETLIILRNKESKTIKKSKQNPIKPLRFQLKKQESYDFYKNHAKFTAFILEELLENQKDFLNKLLKKYKQLKG

SEQ ID NO: 745 - protein, 123 aa, Borrelia garinii
MFSCSGFLTLEGKERSSFTDKQRISVLETIKNHYNGDSEKISRVDKYFDRLEDSQRDVVLQLFSAGFDYINAKESEPTDSANRSANLAALKSDFESKLKKLNYTEQDFEKLADDLNKFVESSN

SEQ ID NO: 746 - protein, 130 aa, Borrelia garinii; identical to SEQ ID NO: 252

SEQ ID NO: 747 - protein, 388 aa, Borrelia garinii
VSKKVIILSISIMISILSLSCDLRKANAESGVDSIISFGKNYWNNLACKYLSGSEKSIFNALPKSKKSQVLDSILKEKNGEGAKQLLINWGIDFEMASSIAINIDKELVELKNSQVRLLDKDSYEVSSTVDLMIKSNDENHRLLGQNAYFDVENGSGDYNVLYSDFSSYDSSLDAVISSDSDLNNNDNANKNYLSNQNYTYQEYTDKQAQEIKERVKKYKIFKENVYKLSQTLRQSTFYAEELNTKLSGIDNKESNFILKVEDIKDIIRLIARIKMTQYTELSKKILDKNFSSIANDEESKRYALLYKDTNSTYLEVRKILGTILSKISSIVGGFKANIVDIKDSEKIKKAKEHAQGVLDILKLIDSGENVEAILTKAKEVENISNNK

SEQ ID NO: 748 - protein, 157 aa, Borrelia garinii
MRILVGVCIIILALLGCYLPNKQKQAAQAFFDENSPQSSDMGSNEIVTEGIFANLKLYKAEHRLLINIKETLISLKDANYNNVPPVGNRYNEENFNKFFLDLGSERSKELIKLFGRIKNDRNLFEKKVSLLFSCIEDNSSNGIDFRPINAIFEDGKE

SEQ ID NO: 749 - protein, 60 aa, Borrelia garinii
LLDIKKYLIFILLSNLINCNLFNKNKNSDQVNNIISSLDTNQKQAFKFFKDENLLMTAHL

SEQ ID NO: 750 - protein, 67 aa, Borrelia garinii
MLETKVNENNLYNELVRLGMNKILASDLATRFYHNEITIKDLEIVKLELQGFIKDEISIVKDEINAV

SEQ ID NO: 751 - protein, 11 aa, Artificial Sequence
  Synthetic polypeptide
KLKLLLLLKLK

SEQ ID NO: 752 - protein, 36 aa, Artificial Sequence
  Synthetic polypeptide
  misc_feature (22)..(22): Xaa is ornithine
RLAGLLRKGGEKIGEKLKKIGXKIKNFFQKLVPQPE

The invention claimed is:

1. An isolated protein:
   (a) having the amino acid sequence of SEQ ID NO: 152,
   (b) comprising at least 95% sequence identity to the sequence set forth as SEQ ID NO:152.

2. The protein according to claim 1 (a), wherein the protein is encoded by a nucleic acid molecule set forth as SEQ ID NO: 18.

3. An isolated protein that consists of a fragment of SEQ ID NO:152, wherein said fragment comprises an amino acid sequence selected from the group consisting of: amino acids 8-23, 25-33, 57-68, 102-113, 194-199, 236-241, 269-296, 326-333, 339-348, 352-360, 364-369, 378-393, 422-430, 434-447, 476-484, 488-501, 530-538, 542-555, 585-592, 596-609, 638-646, 650-663, 692-699, 706-716, 726-745, 765-771, 792-798, 809-815, 825-835, 862-868, 878-885, 893-902, 911-922, 927-937, 947-953, 962-970, 978-985, 1011-1017, 1027-1034, 1045-1052, 102-177, 285-364, 937-983, 27-246, 701-1067, 937-962, 958-983, 102-130, 126-154, 150-177, 823-849, 845-872, 867-892, 285-314, 310-339 and 335-364 of SEQ ID NO: 152, and wherein said fragment is less than 1067 amino acids in length.

4. An isolated antigen, wherein the antigen consists of amino acids 8-23, 25-33, 57-68, 102-113, 194-199, 236-241, 269-296, 326-333, 339-348, 352-360, 364-369, 378-393, 422-430, 434-447, 476-484, 488-501, 530-538, 542-555, 585-592, 596-609, 638-646, 650-663, 692-699, 706-716, 726-745, 765-771, 792-798, 809-815, 825-835, 862-868, 878-885, 893-902, 911-922, 927-937, 947-953, 962-970, 978-985, 1011-1017, 1027-1034, 1045-1052, 102-177, 285-364, 937-983, 27-246, 701-1067, 937-962, 958-983, 102-130, 126-154, 150-177, 823-849, 845-872, 867-892, 285-314, 310-339 or 335-364 of SEQ ID NO: 152.

5. A fusion protein comprising the protein according to claim 1 or claim 3, or the antigen according to claim 4, further comprising a heterologous amino acid sequence.

6. An immunogenic composition comprising the protein according to claim 1 or 3.

7. An immunogenic composition comprising the antigen according to claim 4.

8. An immunogenic composition comprising the fusion protein according to claim 5.

* * * * *

UNITED STATES PATENT AND TRADEMARK OFFICE
CERTIFICATE OF CORRECTION

| | | |
|---|---|---|
| PATENT NO. | : 8,129,165 B2 | Page 1 of 1 |
| APPLICATION NO. | : 12/440161 | |
| DATED | : March 6, 2012 | |
| INVENTOR(S) | : Urban Lundberg et al. | |

It is certified that error appears in the above-identified patent and that said Letters Patent is hereby corrected as shown below:

Col. 127 lines 25-28 should read

1. An isolated protein:
   (a) having the amino acid sequence of SEQ ID NO: 152, or
   (b) comprising at least 95% sequence identity to the sequence set forth as SEQ ID NO: 152.

Signed and Sealed this
Nineteenth Day of June, 2012

David J. Kappos
*Director of the United States Patent and Trademark Office*